United States Patent 10,724,096 (METHODS AND COMPOSITIONS FOR INHIBITING AND TREATING NEUROLOGICAL CONDITIONS) - sequence listing, part 66

SEQ ID NO: 1463 - DNA, 282751 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaactttggtgtgtcttttatacttacagcacatctcaatttgaacaagccacacttaaagtgctcaatagccacgtgtggctggctagtggctaccatgttagacagtgcagctctggagtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttataggcagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgatgaattctagttctagttgagttaaataggtctctatggggcaggcctaggaaaagtgggggctgctataaccagagtagcttgaggagcatattgtatctttactcttaagttcatacataagacataattcatacataaaatttattttaacatatagcttctgtaatttaagaattctattatggcgtagatttgggagtacttgatttaatgggtttttgtccagttctagaatcatagctctgagaaatcgtaaagacctagatctcatggctagactagtccagagaattatctatcaagaagcaaaagggaaacagttgagggtcctcaatctagatttatttcgattcctccaataagggtttcacctcttgaaaatatcaggagactttttcattggggtggagtgaaatgttttgattctgaactattgaaacatggtgaggttgtggaagatagagaagagccttaaatttcttttaacatatagtttctgtaattaatcaatttaggaattctgttatggcctagttttcggagtacttgatttaatgagtttttatctggtactagaagcatagctgtgaaagaccttaaatgtatgaaactcatatccttttcagtatttacagcttgttattaataaattgtctctttagaaatagactaatggtgaagtgggtttattcacatgtgacttatttgatatgttaatgtagtggaatttggcattattccaaagatacagaaagagattagacttcagactttcatggcctcgcctatggtataatctccagaatgtgagtatgaggaatccagtaatgaattcatagtgccctggtaggcatagtcactcttgtgacatacttggtgtatatacataccagagttaattactggtccagaagaacttaatctcaagagccaatttctggttatcccaacatggcacagtataaaatcttatggaaaaaaaatctttgtcattgagatcaaattatagttttcatacagtagatttatattgttgatgttttactcatgtttatgtcagacttaatttatatttgtagaatctactgtttctgatgatttagagaatgggaaactgaaagaaattttaaagaattaagtaaaccttgtttgttctaatgggtttctagtgaatctccttcaagttggggcatagagattgagaggagaggttttttaggagagtctcaaacaggaagacaactcaaataagtgtttattcctcttggttgtcagtgcttcagtaaagcttatttatttatttttttctagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggtcagcttcttctgtactttttctgtatcattttatgtgctctgtttgttttctgaatgaaatttggtaaatttcatctaggtaatatagtgtaatagtgaaaaactgcttagaatctagttctattactgctctttgtggaactttgggcaagttcttaacatccttgttcctcagttcctcaactttaaaatggggacagtaatagttcctgccccagagttgttaaagagggttaaataaaaggatgtgtaaatagcacttgacacttacaagctatatctgataattataattattataaacctccactccataaaaaacccattcataccacagaagtatagaattcgtaccggctaacaaaggtacagatttacagggataaaaacaaagtattttgcttcatgttaaagataagtgtttctgtgatttgtgtttgtgtgtataatttcttttaaatataaatcatatttcaagtgaaaatatcacatcattacagaagagtttattttccaaaccaaaacttttttcattcctaatttttaatgcaaccttgttaaggaagaaacacctaagcagtatgatatttactaatgtctgttttacttgtagaatttgcatttattttatcaattattttctccatttcgtgtttggagaataagtaattcagaatcaaatgtatcttctacagcaatatttagttcttgtttatgcccttgtttcaatgagtgctgcagtgtacttattttattacttccctatagcaagtagatagaatttcctgttacttcctctttttttgtcatttctaattgactgggaggtacattatattgttactgcagtagatttacgttatggtgtttacctgtccatgttagaatcagtttacatttctggaatctggaataggataatatctatttgatttgaaattgaacagatggtagcattatgttggtccagataatctcatttctcatttggacaagatattttggggtttgaaaaattcctataatgattaaaggaaaaagctcttgtgagttattgtatgcggagacacacacacacacacacacacacacacacacacacacacagtttattgcattgttagattttatacataaaattacccaagttgcaaatatatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggtaaatgtgaatagtggttttttttactcagtctgcctcaaagcacatggcatctgattttgagaatgtatttaaggtcactactttgtaagtttacaggggaaattcaagtagcttacttgaaatccttttctgaacaaagtaagatgaaaataaaaagcatttgaaataaattgttagtcttccactgagttgttaatatgctatacattttaaaaataactggcagtagatgttactatcagttatgattatgtaatttactctgcctaagttgtagatagtgaagttttacaaacattggcgtatgttttgagtaaattgtaggtgggaatagctattttattctgtggacattgtagagtccaagataagtacctttcctgtgaggttagtgaaaggaagtttttggctttatcatttgaagcatttgctctgctcttcctactccttttgggtggagcttatcaggttctccattggcaggcagggctctaagtgcagtaacttgatttgctgttgtatttgcttaggaagagcagcacttcagaaaagagtgatggcactgctgaggcgcattgagcatcccactgcaggaaacactgaggtatgcccttagcaacagaaacacccctcccaggcgcccaccctcaatttggaagcctcttgttacatatgtgtgatcaggaatagcttttgaagtaaatccaagatacgtgcatattacaagtataatatctgagtatttaatatacatcaagtttgaaacttggctgtagctgattgatgtttagctctagactaagttgctttcaagtgataattgccttcattttaggcttgggaagatacacatgcaaaatgggaacaagcaacaaagctaatccttaactatccaaaagccaaaatggaagatggccaggtaagtctgtaaagttgacttttgtctgttaactgatctgctaaatatatgtacttcactttgataatctttcaagagtcgctcagtaaagtaaacatatagctgtgtgaagactgatatttagttgtggtttatctagacctgtactttgtaatgtggtagctactagctatgtgtgactatttaacttaaattttaacataattaaaattaaataaaatttagttcctcaatcatatagtaaccacatcgcaagtaccagtagccacatatgacaattacttactctattggacagcagagagagaaaatgttcctgtcatcacagaaatactgggcagcactgctagagactgtttgttgcagagaccatttctttaccttttcttgctctttctcccttcatcagggtgtttcacagaattttcagaaaaggagcaacagaggtagagataaattaacatggaaacaattcattttgctattttgttaggtattctaattaaggaatgtcttaggcagtagattgatcccatagagtaaatgaaattttaaaatgtggacagttcattcaactattactattgactatattatctgttactttggaaattaatgatcagttagtgtttgtgtgtatttgatttgtaatgttcatattgctctcattattaggtgatttataaaaactggttgttcctccatggtgtttttgtcatgcttaattacaataggaaaaagttatatttttacgaagcaaatgtgtgtacctaatacctttatttggaggggacatgtagctttagaatgaaagcttttggggggataactgttttatataattacataccatacagttcacccatttaaagtgtccaattcagtgactgtttttaatgtattcacagagttgtgcaaccatcaccacaatcaagttttagaacaatttcatcaattgagaaaaaaaccccgtaccctttagctatctctgcctctaaccaccccccacccactttcttgcctctcttcccccaacgtctctagccctaggcaaccatgaatctactttctgtctttgtagatttgcctattccggatatattctgtaaatggaattatagaatatgtgggcttttgtgattagcttctttcacttagcatgatgtttccaaggttcatccatgtgaaatcaaaactttttaaaagaaatttgacactcggctgattatattagtgtatgataaaaatagatcagtggctctttaaaaatgtatatggtaattttatgggttgattttaatgtatattttacattttttgtacttttgtcatggaagaaatgttggataaagcataatttgtcaagtctcaactaattaaggtttaattcatgctttgcacaaaaattttgtgtttaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggtaaagtgttctcttatttttcacctttctctatgaatagagtgacttgtttgaaataagcctttttctttcagattatttaaattaggtactcacagtttttaaaaatttccaaaaaattgcagaaagaagagtcatctcaatgtaggggtcagcttgcctcttaggaactctggtgtgtatgtgtgcctaagggtatacgtgccctgtgtatgggtacgagtgtctgcgtatatctgtatgcttatttggctctatgcctgtgggtgcacttactctgtgtgtttagatcagtcagtttcatctctctagggggtctgtcttctgggcattgatggcaaatcattaatgtatttgttctttctttaggttttattgactgataccaatactcaatttgtagaacaaaccatagctataatgaagaacttgctagataatcatactgaaggcagctctgaacatctagggcaagctagcattgaaacaatgatgttaaatctggtcaggtaagcattctactgaaatgtagcagaaacattttaagagataagaaaaacctcttacacactgatactggtagtaattgataaaataactggccattctttactgcacacaaactagggtgtgacagtaaggtagccagaagttgtgtacgttcttttctaaataaatatcttattgttttcaaacttacatttaattcgttttacttgatgactaaagtatttagaatgccttctcttttgtctatatctgataatttttttattgtttctatgtctatataggtatgttcgtgtgcttgggaatatggtccatgcaattcaaataaaaacgaaactgtgtcaattagttgaagtaatgatggcaaggagagatgacctctcattttgccaagagatgaaatttaggtgagttctcaaaagagcaatgtagggtcttgtaaatcttaatatgtccaatgaagtacagaaaaagagtagatatgcggttattggtagaaaggaggacatgaaaagagagcaatttacatgtttgtttttctctacatctcttctcaaatttccctaagctttgtgcctgtgacaatgctccctttttctaaaactgtgctatacttgagctaagaatttgattctatttccaatctgataccataactaagggccatgatggaggataaatatccatgttgcttgttcccttctggcttttatgtctgtgatagcagtatctcttttataaagtcgtcatgtcacttaggttatctggcaaattatttgcactataagaaatcttacgtgactaaaggtgtgtgtgtggcttcaaaaacattgtttgctgtttctcttttctccaccattctataggaataagatggtagaatacctgacagactgggttatgggaacatcaaaccaagcagcagatgatgatgtaaaatgtcttacaaggtaaaaaaagaatgaccttcaagtattagtgggttttactgtgagagttataactacttaattacagctttatacttgtattttgtgtgtatttaaacttttgagatgtcaaacttttgtgtttgaaatatgtaaagatgctaatctttattactgcttttttttgactgatagactttcagtaaaattaaatgtgaaagagtgatatgtttgggaagttagtgttgtcagtttatgaagaatagtctacagttattgggaaataagatacataaagcctcagattgcatttgtgttatgattagatagataaaggtattatttgaggaactcattgtgttgaatctttttaagaaataattgatttcctgattcaagcaccagagacagaaaaaaaaggaagtaatcaagtctgctttaatgatacttattgacacatatcagaaaatgattaaacactatggactgtataataagcattcacatatgtttctttgaccaagcctagctttataatacagtcttctctgtcagggattggttccaagaaccactccccaaacccctgcccacatcttactcccatgaacactaaaatccacagatgctcaagtccctgacttaagatgtcatagtatttgcatataaactatacacatcctcccatatatttttaattatcttcagattacttataatatctaatacaatataaatgttgtataaatatttgttataccatattgtttagggaataacaacaacaaaaaatctgtacatgttgagtacagatgaaaccctccttttttttcccccaaatattttcaatccatgggtggttgaatccatggatatagaactcactgatacagagggcccattgtacatgcttctgatttaaggtagccattttgccaagattactttgtagaaagtaagtattaccttctccccatttgagatgattttgtattctgggatctgcatattaactcaaattatttgggttgtgctaataatttgtttaatgaaataggtagttcctaaggtttatatctgttagtaagaggtttatttgaggggaagtgaaagaacttgaaagattcatggtctctaaattttttttttttttttttttttttttcagagatttggaccaggcaagcatggaagcagtagtttcacttctagctggtctccctctgcagcctgaagaaggagatggtgtggaattgatggaagccaaatcacagttatttcttaagtaaatttcagtcaccaaaaaacataaagcaaaaagcaaataaagccccccaccacacaaaaaaagcaaagaaataatacccatgacaggactaggataggaaaataactgtgttttgtgatttttttaaagaaagtaatatgatcagtgaaattttgcttataataaaacccagattgcttcattaagtcatttacaaaagtgacattgtctaagctgtttggaccactaattttatatactaacattaaaagtgacacatttaccaggtaatattgcatctatttgatgctaatgttatgaaaggtatactaggctatatcaggtaaaatcatgtccaacatagcacacttcataataagccaccctggctgattatcgcgagagaggagagaaacagttaacccagggccattcacaccatgcacatatgattgttttggaatgtctggttagctttctagttgatacggccttcactatgtaaaggtcagtctttttatttctcagatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggtgagatcaaatgaaagtttcatatagaaatacaaaacctagagaactggcatgtaagagaagcaaaaattacttcagcaaggccatgttagtaaatttgcatctgtttgtccacattaggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggtaagtgattagagtaagcggggaagaaaagtgcctggcacatagcaaatccttcagaatatatttgttcaataaatgtttgttgaatgaattgataaaatttcagagccagaagaaagatgtttagttaggtgatttttcagctgtagggaagtggttggcaccactagacctgactagtgttctgtatcatttcatcctactaaaaaattccatttaaacgcattaaaaatcactgatctactctggtgtcttcatatatttgataaggtaattaggttaaacctaattttagttagttgttgcaatgctggaattggaatccacgatttgtgcctgtttactacctccagtttgctattcttttccccataatgtctcatacagttttttaaaaatttaagcactatatttgcatttgatattatgatattgtttattttaaaaactgaaagcgtcatatggctatgtctctctcttaatttaatgaaaaattttcctaaaatcacatcattcttaatacatgctaaaacgttgagacgggttgttgttcctttccagtgttaaaaggctatttgctttttagtgtaccaaaactgatttcagttatagtaaattatgactaataaggtaatctgtccttgttaacaagcctgtatttgttatacctgtacttaaagtaaaattcaaactccttaccctgtcctacaaggctctacctgatctgggccctacctcatctctaacatcatcttatgctattttctttcttgttcaccagagccacaccagctacctttctgtccctccttgttagacttatttctgctttagagcacccttgctgctgccaccacctgaaatgcttctcttctggtattttattttggtgagaacacctggcatgagatctaccctctaacagatttttaagtgtataatacagtattgctgtctgtaggcacaatgctgcacagcagatctctagaacttaccttgtataactgaaattttatactcattgattagcaacagccccaaattattgaaacctccttgaagcctaaatttcagaaatgttcaaatgttttgaaaatggatattctgaattatcttattagcatctacctataattagcactgaaaatagtaattttttaaataaagaatcagttaagggccgggtgtggtcgctcacgcctgtaatcccagcactttgggaggctgaggcgggaggatcacaaggtcgggagatcgagaccatcctggctaacaccgtgaaaccctgtctctactaaaaaaatacaaaaaaatcagctgggcgtggtggcaggtgccaatagtcccagctacttgggaggctgaggcaggagaatggtgtgaacccaggagggttgcagtgagccaagatctcgccactgcactccagcctgggcgacagagcgagactctgtctcaaaaaaaaaaaaaaaaaaaaaaaaaagaatcatttagttcaagtagctttaattcgttgagttttatattaaatgactttgagaaggaattttctgttaggccagatctcacctaccacattattgtaatccttggatcaggcaagaattagagagctatgagccatgatcctggcctttgttgttactgcttgaggattgaggcatctttttatggctacccctattatctataaatttcttcttatcatgtgattaaacagtgatttaccattagatcattttttcttgagtgtaccccaaactgttttactacagagagttataaaggatgtcatttaggtaatagatagaaatttcagccctcatccttgtgaccctagctttgtatgtaaatctggctcatctctgggttctgaatgcccaattccttttcttcctggtttctcaaaaatcctatagtctttctgtttttgttgtgtctctgcctagtatatattcagtattcgctgagttccccgactgtatgagaagagagtagaactcttctgatcatcaatcttatttctgctctgtgcaaatgcttgtacaaatcaaactaaattctttgctgtcatcttctgtttctgctctctttcattttgtgatgtaatttgagctgaatcttggagattttgtctcctagtaaagcgtaggcctctcttaatagcttttaccggttaatccttggaattaacagctatcatagacattgtatatagtcatctatcataaacaatgtacactgttaaatctcaggataaatattaatcagtcatcatttgccttaatttagcaagtggttgtcaactttgggtttacatttttgctactctttagcttcctacctaagaataaaaatgggattgtttgcactaacctgattttgttttgttctcaggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtttgtatcattcattttgtgtgtatgtgtgtgctgaggtatgtcaagtaatgattatgtacagaatgtgcagggctgattgtcttcttttaaggtaaaatatatggagcaggtataataaactcctattcgtgcatttctgtaggtatatggtgctacctatctacaaaaactcctggatcctttattacgaattgtgatcacatcctctgattggcaacatgttagctttgaagtggatcctaccaggtttgtcatcttttcacatagaaccgctgttttttgtttttttttttttgtttgtttgttttactaacactgcatgaagcaaggcaccttctccccttgatcattaaaattagtttttaattataaaagttatatacaaatacacgtttctttaatgatatctgtaatttttttttaaggtatccttttatttgccttagatccagggacaaactagagaaaggtgtctttgacttccacctccagagactgttactagttaagtctgttcccctgtcctttttccatgcatttacatattcatatgcagtcacttgcatgcatactctttttctaactcacttcttctatgatgaggagtgacttaggagaagggaaagaggctaataggtaatgcaggctgcagtttatttatttgtcatttttttaaaaatttgagacagagtctcactctgccattcaggctggggtgcactggcgcagtctcggctcactgcaacctctgcctcccaggttcgtgtgattctcctgcctcagcctcctgagtagctgggattacaggtgtgcgccaccacgcccaggtaattttttttttttttttgtatttttaatagagatggtgtttcaccatcttggccaggctggtctcaaactcctgacctcaggtgatccgcctgccctggcctccaaaaatactgggattacaggtgtgagccaccatgcccagcccagagtgcagtttaaaccaccatttctgtgaagctttctctgcttgttaccaggtactacccacgaacaaagaaatatgctttgttctgtgctgtgcaccaccattgtaacaattgtgacgatttatgagtttctctctcctctagactgtttgctcttttacatttttacatctttatatccttccatgaatatttagcatggtgtctgccttatagtgaacattttataaatatttgttaagtgaatgaattttaacggaatatcttatgcttgctttttctaagccacatgttaagatgttcttgtctgtctttcagttaggactttattttttacttttaagttcagagcttcttgatgattgttcttcctaaataatcattatttagcaactgtgtatcagttgatatttttggctctgcatttgctgaagtatcaactgtaatatctattcagaactccagcactaagccaatttttgttaaaatagttaaaaacttaaaagcaatttttatatttttatttacttcttattttttgaaatggggtctcactctgtcacccaggctggagtgcggtggcaccatctcggctcactgcaaccttcctgtgcaggactcaagcgattctcccatctcagcctcccaagtagctgggattacaggcatgcaccaccatgcaaaatacaaaatttttgtattttggtagagacgaggttttgccttgttgcccaggctggtctcaaactcctagactaaagagatccacatgctgtggcctcccaaagtgctgggattacagatgtgagccaccacgcctggccaaagcaatgttttgtaaagccttgtattttcttgccattaagcactttcagtttttttcttgacaacttctcatgtctactttttttttttttttttgcaattttcaagtgtacataatacattattacggattttatgttaattttgtgccctacaattttactgaatcttattattaagcaattttactttctaaaggttaaagaattacttagagagtgaaccagctgcttcaaataagtttactatacaaagtgctgtggtccagataagagaactagatggcaaacaatatactcaggttgcttaaaatcaaactgaggcccactctgacatgtcaagagcttgaaagtcaacactcctgtgttcacaacatgaaaaaagctaaaaaactgaaaatcagcagctcttagatccatcagagaatttaagtccactccaaaaactggagagacaggtaaatgtatacagagaatcacagtttaccaggagaagaagctgctggagccagtaactggtaggaaagcttagatcataattgacgagttgctggaggctgagcatggagtgcctagagagttaaaactcctaggggcctagtcttgcagggacccctgcacctttgtaagttttacctccagaagcctcatcaggctctcatggtgaagataggagaaaaatccctttatgctttgggcaggggaaggggaaaagtagccatttttaaatatgaccacagtgttctgttatccctagcaaaggtttgccctcaggagaaattactttaccagagctttatttgacttagaagttagccacctccagccccctctagcgtttctgtaagaagagagaaaaggctaagaaactctttgagtctggcctggtggctcacatctgtaatcccagcactttgggaggctgaggtgggcagatcacgaagtcaggagatcgagaccatactgtctaacatggtgaaaccctgtctttactaaaaatacaaaaaattagctgggtgtggtggcacgtgcctgtagtcccagctaccaggaggctgaggcaggagaatcgcttgaacccaggaggtggaggttgcagtgagctgagatttgcaccactgcactccagcctgggcgacagagcgagactctgtctaaaaaaaaaaaaaaaagaaactctttgaaggtcacactttaaggaatttggcccaataaaacaatggagatataatcagattgtagagtacttcccttccccagtatcccagttaacggggaaacccagggacaacaaaagagacagaaataagagcactagaggaaatgggcgcctacagttacagcgaacattaaacataacctaacttctaggcagattaacagaatgcctcacactaaagtccaatttacctcagttcctatgacccaatacatcttgtctggctttcaacaaaacattacaatgcatgctaacaaaaaatgaaaaattagtctgaggagacaaagcaagcatcagaatcagactcagatgtggcaagatgtattggaactttgaaattgtcaaactgagagtttaaaataactaatatgctaagggctttcatggaaaatggacagtgtgtaagaacagatgggtaatgtaagcagagacatggaaattaagaaagaatcaaaagagaaggctagagaaaaaagctgtaacagggagaattcctttagtgggcttatcagtagtctgggcaccactgaagaaagaattggtgaatttgtagttatatcaagagaaacttcccaaactgaaatgcaaagacaaacagaagaataaatgaaaatgaaaatacatcaaaatttgtggggtttaataaaagcagttgcttagcagtgttaaatgtatgttagaaaagaaaatctaaaatgaattatctgagctctcaccttagaaaactagacaaagagcaatacctaaagcaagatggggggaggaatcagaaatcaatgaaattaaaaataggaaaaaaataatgaaacgcaaagctagatctttttattttttaatttttatttttttgtgggtacatagtaggtgtttatatttatggggtacatgaaatattttgatacagacatggaatgtgtagtaatcacttcagggtaaatggggtgtccatcacctcaagcattgatcctttcttttttcttttttgagacagagtttcactcttgtcgcccaggctggaatgcagtggtgctatcttggctcactgcaacctccgcctcccatgttcaagcaattctccttgcctcagcctcccgagtagctgggattacaggtgcccaccaccatgcctggctaatttttgtatttttagtagagacagggtttcacaatattggccaggctagtcttgacctcctgacttcaggcgagccgcctgtcttggcctcccaaagtgctgtgattacaggcgtcagccaccgtgcccggcctatcgtttctttatgttacatacaatccaattatactcttttagtgatttttaaatgtacaataagttcttgttgactgtagtcaccttgtgctatcagataaccagatctcatttatattcttttgtacacattaaccatccccggtctccccttccccaccccccactacacttcccagcctctgggtaactatcattctactctctatctccatgagttcaattgttttaatttttttagcttccacaaataagagagcgcacgatgttgtatttctttgcctggcttatttcacttaacatcataaccttcagttccatccgtgttgttgcaaatgacaggaatctcatgttttgtgtctgaatagtactccgttgtgtatatgtaccacagtttctttatccattcttctgtggacagacacttaggttgcttccaaatgtaggctattgtgaatagtgctgcaacaaacatgggagtgccgatatgtcttcaatatactgatttccttttgtttcagtatatacctagtagtgagatttctggatcatatagtagttttatttttagttttttgaggaacctccaaatggtcctccatagtattatactaatttacattcctgccaatagtgtatgagggttcccttttctcacttttctccttgtcaccatttgttattgcccgtcttttggataaaagcaactttagggtgatgtgatatctcattgtagttttgatttgcatttctctgataatcagtgatgttgagcaccttttcatgtacctgtttgccatgtgtattttgtttgtgtgtttgtttgttttgagacacagtcttgctctgtcacacaggttggagtgtagtggcgtgatcttggctcactgcaacctctgcctcctgggttcaagtgattctcctgccacagcctcctgagtagctgggattacaggtgcctgccacgatgcccagctgatttttgtatttttagtagagacagggtttcaccacgttggtcaggctggtcccaaactcctgacctcaagcaatccacccgcctcggtctcccaaagtgctgagattacaggcatgagctaccatgcccagccatggaatatcttttttctttgctttattttcagtctgtgtttttccttatagatgatgtctgtttcttgtaggcaacagattgttgggtcatgggttatttttgtttgtttttaatccattcaatcactcttacgtcttttgattggagaatttagtccatttacattcagtgttattattgacgaggacttactcctgctattttgttatttgttttctggtggttttgtggtcttctcttcctccttttcttccttcctgccttccctttagtaaaagtgattttcacagatgatatgtgttaatttcttgctttttattttttgtgcatctgttgtatgtttttgatttgaggttaccatgaggcttgccaataatattttatgagccattcttttaagctgatgacaagttaacactgatggcataaagcagcaaacaaagaagcaaaaagaaaactaataaaaactctacactttaactttatccccctactttttaactttttgttgtttttatgtataccttattatactgtctgtatcttgaaaagctgtagttatttgtaaaaggttcatcttttagtcttctcaagatagtagttcataccacaattacagtgttataatattttgtgtatttactgttaccagtgaattttgtaccttcagatttcttattgcttgttaatgtccttttccttttgattgaagaactccctttagcatttcttctaggacaggtctggcattgataaaatccctcagcttttgtttgtctaggaaagtctttatttctccatatatgaaggatattttcactggatactgttctaaggtaaaagttttttttttttctttatcacttgaaatatgtcatgccactctctcctggcctctaaggtttccactgagaagtctggggccagacatattggagctccattgtatgttatttgtttctttcctcttgctgcttttaggatcctttctttatccttgacctttgggagtctgattattaaataccttgagttaatcttctttggtttaaatctgtttggtgttctgtaaccttcctggacttgaatattgataaatatctttccctaggtttcataagttctctttttttttttttttttttttttttttgagatggaggttcactcttgtcgcccaggctgcagtgcaatggtgcaacctctgctcactgcaccctccgcctctacctcctctttaaggccagtaactcttaaatttgctcttttgaggctgttttctagatcttgtaagcatgcttcattctttattcttgtctcctctgtgtattttcatataggctgccttcaagcttgctaattcttctgcttcatcaattttgcttttaagagactcttgatgcatatttcagtatgtcagctgcatttttcgtctccagaatttctctctggttctttgtaattgtttcaatctcttcgttaaatttatctgataggattccgaattccttctccacattatcatggatttccttgagcttcctcaaaacagctattttgactcctcggtctgagaggtcacatatcgctgtctctccaggattgatcactggtgccttctttaattccttcggtgggtcatgtttttctggatggtcttgatgcttatggatgttcattagtgcctgggcattgaagagttaggtatttttgtagtctttgtagtctgggcttgtttgtacccacccttctggggaaggctttccaagtatttgaaggcacttgggtgttgttatcttaagtctttggtcactgcagctatatctgctttaggggacactccaagcccaataacgctgtggctcttgtacactcatagcggtaccaccttggtggtcttgcataagatcctggagaattccctgggttatcaaacagactcttgttctcttcttctcttcccttactttcctctaaacaaacagagtcagtctctctctctgtctgtgtgtgtgtgtgtgtgtgtgtgtgtgttgagctgcctggagctgggggaggggcgacacaagcagccctgtggacaccagcactgggagtgcactgggtcttgcccaaggcctgcagtactgctgcctgactaccacctatgttcactcaaggcccaaaggctctacagtcagcaggtagcaaacccagccaggcttgcgtcctttcgttcaggcagtgagttctccgtgggtccagagatgccattcaggagccagagcctagagttgggtacatcagagatctacctagtgctctattctgctgcggctaagcattaagctggcacccaagctgtaagacaaagtccttcccgctcttccgtcctcttttctcaagcagaggagtcttttcccatggccgccatcgccccaggcccatggtgagtgctgcctggctaccactgatgttcactcaaggcccaagggctcttcattcagctcatggtgaatgctgccagttctgagtctctcccttaaggccttggggctcccctctaacccagggcaggtccaggaaagttttccaggagccaaggcctggaatctgggaccccaggagcctacttagtgccctaccccactgtgtcaagctggtacccaagttgcaacacagagtcccctttattcttacctcttctttcctcaagcagaaggggtctctctccatagccaccacagttggtaatgtgctgggtcacccctgaagccagcatgtctccaagtctcacccaaggcccacagcaagtactgcctggctatccctcctggttgttcaggggccaagggctctttagtcagcaggtgatgagttctgccaagactgggtccttccttttaagacagcagatttccttctggcccagggtttgtttaggagtgttgtctgtgaggtagggcctgaaatgggggcctcaggactctgcctggtgccctctcctactgtggctaagctggtagttacaagacaaggtcctctttactctctccactcttgtatttgaacagagggaaggcatctctgttggagctacaagctgagctgagctgcctgggtttgggagaggggtgatgtaagcattcccttggttgccctggctgtctcactaggtccaccccaagtccactggctctgagcccagcacagcaccaggacttacccagaaactgcagtccttgtgggcctagactgcctttcaagtttatttaggacctcagggcactttagctcttggtggtggggcttgctggaactcaggtttcaacagctgggatgggtgatttacctctggctaggtctgttctaagttctccatccttgagcaccagctgagctctgccctgtgttgctttctgctatgacagggcagcatttagtcctaatgcaaagtcccataatcactgtgctgtccgtcccccaaatgcagattttctttgcacaccacggggccactgccaggaggtgaaggaagggtggtataggtaagtcaagacagtttttcctacccgcttcagtgcctcttccttaatatgatgttaagaccaggtattgtgatcacttacctgattttcagttcttatgaaggtgcttttttgtatggatggttgttcaagttggtgttccaataagggggacgatccctggaggcctccattcagccatcttgctccacctccagttctcaagctagttctttgaaaatcaacttgggaaaagttttatacacaggaacacttgaataattgaacacaaatgttcattgtagttcagaattagtagaatattcaacaggttaccattggcatgtgggaagcaagagagcactgtggctagaaggtattgttttagagggaaacctgaaatggactgcagtgtacctgctgctatgctgactcaaaaaaaaaatttcacaaagtaggcaattgtcagggtttctagcagtctctttgagccttgttaaagaaattgttaatctcattcatacctaccaactcctagacctccatatcttaagatttggattactgttgtagcttaactgttctccctgcatataatccccatatttaggctgtctcttcaattagccacatattgcaagttcattttcctcctctggcttcctaacaaccatcagccattctccaatagataccaaccaggtgtccttgtgattcagttcaaccgtgacactgtttacctggagagagcatcagatttcccataggataagggctgagtaagattgctaccacttcagatgccaattacaagccccaggttgttacctgtgcttctcacaacttcaccttgagttggattaatttgctagaaggactcacagaactcaggggcatactttacttttgtttgcctacttactataaaggatatcagaaaggatacagatgaacagccagatggaaaagatgcacatagggcaaggcatgtgggaaggggcttgcagcttccatgctgtctccaggtgcactaccctccaggcacctctatgtgttcggcaacctggaagctcttcaaactctgttcgttgggtttttatggtgacctcattatataggcatgattgattaaatcatgggtcattggtgataaactcaccttcagcctctctcctctccttggaggttggggagtggggctgaaagtctcaaccctctaatcgaaacttggtctttctggtgactagccccgtcttgaagctccctaggacctcccagccaccagtcatctcattatcatataaaagacactcagcacttccagagattccaagggttttaagagcaatgtatcaggaatcaggagcagagaccaaatatatatttatcacaatacccttgaattattgtattgagtacttagtgtggaatacctggtctatatgtctttctcctttttgaaaaggtcaaaaggcaattgttgaatcctcagcacctgatactaagatggcagatagtagatgtgcactaaatatttattggattgattacctgccgcacctactttctctttctgaaatacccttacttcttttgtctatgcaaattctgtgcctcctttagaactcacctgttcaatgaagtatttcttgctttgcagtccatgctaatttctgaactcttactgtattcatatgctgtgccacacagcaaactctaaggaatctacagcaatgacgtaagtgtccaaagcatttctgtaatacgttaattaatatagaaacaaaattactaattaacctgttaaaaacaaatatttactcagtacttgctgtggtaaggcactgtgctagtctttaaggggacataggtaaatacttccttcaaggagcttacagtttagtaagagggataaaacacacaacagataagtggtgagtttcataaggggtgtattttgagagttcagattaggctagttagagagtaaaggtttgtggatttgattactattgggtaaaatttaaactacataaagtaggcattattagtcctgtattattgatgagaaaaaatgacacccagagaatttaaggattgtgaccaactcataatgattgataactgatagagctgaaatttaaacctagtaagtctgcctgcggaatctcttcctttaatcacaacatcagagtttagaggtggtactgataagagttagcaacactgggccgggcacggtggctcatgaccgtaatcccagcactttgggaggctgaggtgggcagatcataaggtcaagagatctagaccatgccggccaacatggtgaaaccttgtctctactaaaaatacaaaaattacctgggcgtggtggtggtgcgcctgtagtcccatctacttgggaggctgaggcaggagaattgcttgaacctggaggcggaggttgcagtgagccgagattgtgccactgcactccagcccggcaacagagcaagactccatctcaaaaaaaaaaaaaaaaaagcaatactgattggatatggggaataatgaagtagagcaggaaaaagtgacatcagagatggcctgaatgatgtgattaagaaagtgatagtgctattgataacatagagcacatgataagacataagagtacgaggaaaaatcagttaatttggggcatactgatttttagataccagtggggaggggacatctagcagttagaaatgtcagactggatgtgaaatgcagttcaagataggggaaacctgaatggccacaaaatatctaaaagcatgtctaaccttagtaggaactgtggaaatagaagttaaaaacatgagctacctcatgttttactcaactgctagattggaggggaataagaattcttatacagtactagttttagagctatttggcaatatctagtaaagttatatctgcatatactcaataactcagaaatttcatttttaggtagctgccttagagaatctcttatgtgcaagaatgttcattgcaatggtgtttgtaaaggtgaaaaatgtttaatgttcattataattagagaatagataaatcatggtatacaatagactattatgcagtaaagtgaactatatcttcatctatcaacatggataaatctcagaaacataatgtagagtgaaagatgaaagttgccttttgttactattgatgaaaaaagtaaagacctacatcattcagccgggcgtggtggcttatgcctgtaatcccagcactttaggaggccgaggcaggtgggtcacttgaagtcgggagtttgagaccagcctgaccaacatggtgaaaccctgtctctactaaaaatataaaattagccgggcgtggtggcccatgcctgtaatcctaactacttgggaggctgaggcaggagaatcacttgaacccgggaggcggaggttgcagtgaactgagattgcgccatcacactccagcctgggcaacgagagtgaaactccatcccccgcccccaccccccaccaaaaaaaaaaaacacctgcatcattcatatgtgtgtgttaattttttcatatgggcatatacacatagaggattgtgaattggaaaaatacatgatattcttgttttatctgtcccctctctcccccttttgttgcttgggtattttaaagcatatctcagagatcatgtttctaacatatacagacttaaacacacatacacgtgcatgtgcagcctgagtatttccacacaaattaaagttaataatcctgaataatatatctaagactagttttctgttaaatttttttcagttatctcaaagttgtctttttttttatttttatttttgagattcagtcttgccctttcatccaagctggagtgcagtggtgcagtcttggctcactgcagcctccacctcccaggttcaagtgattctcctgcctcagcctcctgagtagctgggattacaggcacctgactaatttttgtatttttagtagagatggggtttcaccatgttggccaggctggtcttgaactcctgacctcaaatgatctgtcagccttggcctcccaaagtactgggattgcaggcgtaagccatccagccctgtcaaagttgtcttttttttttttatagttggttgtttaaagattccaatgaagtctacacgttgcacttggcttaatgtctgtataagagtctcttttaaggagtgatttttgttatttgttttaaacaaaagtgttaggattttatttttatttttttgtaggttagaaccatcagagagccttgaggaaaaccagcggaacctccttcagatgactgaaaagttcttccatgccatcatcagttcctcctcagaattcccccctcaacttcgaagtgtgtgccactgtttataccaggtatgcttacagttagagattaccattattaatctaaagttaaattatgaagaatgctttatcaaagaaggatctagctgctgatggtgtgtggttaactataatactgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcatatatgggtagtaatgctcttgctgaagtgtagtttatgactacatgcattcgcgttatgtagtcagcttttaccaagggaagaaagggtacatttggctgataactggtctcaacacacagactggcccaagtttgaccttttatgcagaatgtcttttggatccaaattagatttttatggattaaaaaaaacactagagcatgtatgtattatgaggtaaaattacattgatgtcaattagtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaagattaaaatttgggagttttagaaaaccactcagtagcaatgatggtctatgaatattctaaaattatgtgaagaattttgtgtgtgtgaatgcatacattcatttttctaacctttatcagatttcaaagaggttcctcgtccccagaaggttcaacaccgtactggaatagtcaaagcactggaattttttcttaattttacatctttctatagttttagctaaaacttctgtatctaattctaaatgtatatatttgagctaaaaataaatggtatttaggttttaaagccattctaataaagcagctatatttagtcaccttcaccagtttccccttatttaagggttaaggttgttcttcatgcaataaacactgtaacataaagaaagcttcctgaactatgtgtagtgtaactgaagatggaactatattagttacaactgacctctttttatcacctcttacaaatattttctctaaaatctagtttttactaacttcctgttagagattatagaaagctattttgaggttataagcagtgataacacatttaaaatgtggactgcatgaagcactacattgaacaagatgaagtgaaataatccccattttttccagagttaatctggagtcagcctgtcataatttgtgtcataatttcctgtcataaattatgacaggaaatatttattgaagcattgtgaaaaaaatagctacgtgatattccgcatgtaaatctgggtcccctcccaccaatatcctttgaaatgaaggtttatccttgacatcacagaatattgagtggaatgctacagttttgtagtcactgctactttaaacagcagtttagccgcactaagcaagaatagctgtagagattaaaatgttacattaagtgttctttaaaaatgaacatatatagtatatataaaaatgtaaactgcaaaatataattttcatctatgacatgatttaaagcaggggactctggaaagggatgggagctgaaccagttttatagcactcttcccgagctaaggtacctttttatcttaatgtagaatgttttataaagggaaaatcatccattttaaatattgggttcacattgcttttcaggctggacaaccatttcttgagttcttaaattatttttatttgacagaattataaattgaggtagacataggggttctctcttctggtgagatccttttttcttttaggtccccaagaattcccatccctccatggtttaaataataggtaggttcttgtattataaaggaagctgtgaagaaaaggcactggcagtaacattacttgtaagtaagtttttttttttctcagtaagaatctaatattttattttgtatatggcaagcatttttttcttaaattcaattgtaactggtacacaacaaaatgtaaatatgtactatcaggtataggatgttttgggggtgtgctgttgaaaatttagtttcacgttataaagttgaccacactttcatgtctgttaatcttagtaaattatgatcatctttgtgtgaaaaatttggtctgctttcattactcatcaaacatgcagtataagtgatgatacagtgaagatcttttttcaggtttcttctacccatctcatccatgaggtttttctttcctctgagataccttaattgtactttaatatgatataagactagaattgagaggaaactttattttctcatgttttgggagaagaaaaaaatagaaatatgtcattcatgaggactgattgattcagagtttttatgcaaagtttgacctttgaactctttgttttcatgtctttatattaattcaaaccttatactcaattctcaactccttgtttttaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaaggtgaattattttgataatctagctatcttaaattccccttccaactaaattttcagcttttcttacagtacttcctcttacatttatatttgaaataccctatggttttcagttatgtgcttttgttttatttgtttatattacaaaggaattcattagttaggtacctgatggaccttattttcatgataaaacattttattatagcagatgtcttgtgttatgaagatcattttttgcgtaatcattctagacattctgaaacagactagaatgtagactataggattttttattttaaaagtcattaaacatttttaatatgtatttttacatgtaaatataataattatatttgggaaggttagaaacactacctaaaataatttatagaatgaggaatgtttgatttttaagtactagcagaaattatatcaatgagaaaattcatgtttttaaagaatgtcttaatgtatagacttcatacaataaataatctgattatttataaccctgttttattgtgtagatacttcagagtattgccaatcatgttctcttcacaaaagaagaacatatgcggcctttcaatgattttgtgaaaagcaactttgatgcagcacgcaggtaattttcttgccacttactcagttgctctgtttgaatcaaatattttcggtttcacataaatccatgtacctgttttacatgaagttcctgtgtaagtttttttcttttcctgctctaggtcaagacatagcttgtcttattttattttactataaaagacagtcatgaaataaattaatattttttataatttggtagtgattttcatatttgaaaaccaagagggatttttgacatgtctaattaaataaaggatttgaggatggtacaatatgtggacaaggaagaagtaggattctttttatttaaaactaaaaccaaattggtatcaataatacataacaatgtttaataaggtttttttgatgttagagtatttgtgatacttaaatttggaagtgtatctaaactaaaatgttattctttaaaccaagtcaaacaaacacataagattttgtttatgaggaactgaactttatgattttagaaaacttttctgctagatttctataactagttatttcactttatttctctgagttattggtctatctgtaaagtagggataaactctttgcctgagttgtttttagagaaaaaaatgagataattcataagaaagcgctttgtaaatttatgtctggaattctgcttttcatgcagtgtgaatctaattgatcctcatcatctaagctagccttgtacaactctctcttccagtttatcatcattgtagttgttactgactttttttctgttagagaaattggagttgaaaaggtatattgctgaatgacaagccatgttggaaagagagtgaatgtcagcataggattcatattctggcactctgtgtacccatacaaagttaaaaggatcaaagttttaatcctggctctgacctagcaggctatatatctttggggaggtctttcgtctggaccttcatttccttatctgtaaaatactagcctctttccaaagtttcatccatcttaattttgttgttgtttaacttcagagcctactttgaagctgaagccgggtatcagaaatggaaagccaactttctccttgtcctttttgctttgtctaatgtcaagtcacattgtgtgaacaagccctccatatttgtaatcttagttacttcacaaagttacttcttataaatttaattcaaacataagtctgggtgtatctggtgttgaaaattctaatgactttgcatttttgaaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacaggtaagatttcccagtcatggggatagtgaacactctccgtttaaatttagattaatacaattattggtcatgaatagtgctttttactttgcatcttcttggactaagaattatggtttagaaagagaaagattctttttttcaaaaaaatacaaacaaaaggttaagtcatattaaataatcaacaaacctacctaggttccagtggtcattattattatttttttgtcaggttaagaaatcacagatttgctctttgggtttttatggcttgcagattgttatagatccaaagaagttcagattagcgttggcatttgactctgaagaacagccaattcgtaggaattcagtaattaaaatattgtcagtgttttaattctatgataaactcattcgtgatactcttaagtatatgcaaataaagctttatatagaaaataccggcctggcacagtggattacacctataatctcagcactttgggtggctgaggcaggcagatcacctgaggtcaggagttcgagatcaggctggccaacatggtgaaaccctgtctctacgaaaaatacaaaaattagctgggcatggtggcaggggcctgtaatcccagctactcgggaggctgagccaggaaaatcgcttgaacccaggaggcagaggttgcagtgatccaagatcgcacaattgtactccagcctgggccacaagagctaaactccatctcagaaattaaaaaaaaaaaaaaaatacttaaaaatcaaaattattaatttgggcattgtttcattagctcttattagtctcttgtgtaacataaattacttgctgtcccatctagttatataaacttgtaaagggaccaaattcctatgtatgaagagttccttacaaaggaagaatgagtccaaattatttttaaatgccaataaaaatgattagcacattcacgggaaaagtagtggactgtgaagctaagggtaagcaattgggagatgggagtttaaatgacagggcattttaatcttttatgaattattaatggattgaagtagacatggtcctgaggtctttttggtgctgtttacaaatcagctgacagtaaaaggaaaagcaaccagttacaagttaaagaaatgtgtagtgctaaatgtgaactgctaattttttttctaagtagtttgctgtatctagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggtaaagtacaaccttgaaatagttgattgctttctttttggttgagaaggagagtttgccaccaggccacttgttagatatgatagaagactatgaggaaagatgtatttaataatcacattgccatgtttggggaatccaactatatattatttatatatatagggtgtgttttattttatatattgattgtcataacaatagtaacaaatcatattttatcatcttgctttcataagttttcacatttaatacttaccagggagtgaagacaacattattttcaaattatagttaaggaaaatgcaactcaatgtgaataattgacttgcctaagattccacacctgattcataggtcttttggttttaagtgcaggacttctctactacactataacatttttcagaaccctcataaaggttaatggttttaaattatttcagattaaggttcagaaaatatagtatacttcagtattgctataaaatttctgtggacatttgtttgaatcccatttagtgggatttagtttgtgaatgaaaagatcctcattgttagacacttactctgtgatgatacagtgagagtagtttgctgaatcttttaaagtacctttcacaggactttatgcttagtaagtgctccttcgtgtctgtgatttgagtgctatgttcatagtatgttccaaaacagaataaaacagaatctgatgatgagaagttaaagatttgtatataatatgccttgaattgtaagtgcctgttgttagttgtattacttacaggtcatggttttgtacatataactccaaaccattgatactgttaaaagaatatatgaatatatgaaagaatgtataaacataagaatgtatgggtatatagtgtcctttccaaattaatttttatttttagctctactagattttttttagtgtaacaaatgtttattcctatgtaattaagggcatattttccatacagactattcacattacctaattgaaaattatatactacaaaaatataatactatttttaggccagacatggtggctaatacctataaccccaacattttgagaggccaaggtgagagaattgctggaggccaggagttcaagaccagcctgggcaacatagtgagaccttgtctttattagatagatagatagataggtaggtaggtaggtaggtaggtaggtaggtagatagataggtaggtaggtaggtaggtaggtaggtaggtagatagatagatagataagataagataagataagatagataagatagatagattgggcacagtggctcatgcctgtaatcccagcattttgggaggccaaggcaggaggattgcttgagcccaggagtttgagaccaccctgggcaacatagcaggactccatctctacaaataataaaatattaaccaggtgtgatggtacgcacctgtggtcccagctacctgggaggctgaggtgggaggattgcttgaggatgcagtgaactgtgattgcaccagtgcatttccagcctaggtgacagaatgagaccttgtctataaataaagaaataagtaaaaatataaataagtaaaaagaaatataagtaaatataaatataaataaatataaatataaaaatgaatgaatcaaaacagtttttaaatttgacatcactgaggacatcctagccatttttctagaaaaatatttttattattccttttttctgagatcctaccttcccttacaaagcaatcttttgtgcttttgaagattaagtaatccaatatatataatatacttagcatagtatctggtacttgtaaagtaattaataaatgttggatcttatttttgttctaaattcccactgatgctcttggagacccattttcttttttttaaaaaaaatgaaggtagctttataatattctcagttatttaaaaaattattaaattacttgatatagaaatctaaagaaagttaaaaaaattaaaaattgtttatcctccctctcagaatacttcacttaacgtttggtgaatagtctcccagtcatttatctatgcacatgtacatttgtttctcctatcaaatgatatctaggttgtttccattaatatttttaaaattctgacctggtaccagcagcatgatgggctgagctaatgcaatctcttcccaagacataaggctcatagaaatactaggtgtaaaagaaaatatgtgtacttaaaaaaatttaggccgagtgcggtgactcacgcctgtaatcccagcattttgggaggccgaggtgggtagatcacctgaggtcaggagttcgaggcaagcctggccagcatggcgaaaccccatctctactaaataaataaatatatatatatgaattagccaggtgtggtggtgggcacttgtaatcccagctacttgggaggccaaggcaggagaatcatttgaacccgggaggcagaggttgcagtgagccgagatcgtgccactgcactccagcctggtcaacaagagcaaaactccatctcaaaaaaaaaaaaaaattaaatttatagctgaagctagtttctaagcaaattacctagcatacagtcagtatagacagataaatggaaaatatgaaagaggttaggagatgcagaagataaaatgaggaggttcaaaatatgtctagtaggtgttccctagaaactgagctcagtgagaatgggaagaagtaatatttgaaaggctaatggatgtatgttttctagagttgatgaatgacatgaatcttgaggttgaagaagcacactgagtcttgagcaaactatataaaaattaaaccaggctttaatacatatgggaacataatatatgctaaagctggtattcagaatcgagattaggatggactttcaataaatggttttgataaaactgagtaatgatttggaaaaatattttcataccatttatgataaacttccataaatcaaaaaaaatgagcaaagcaaggcctttttcatccattcaaaatccataaactagaaaagattgataaaatgaattatttaaaaaatcataaacttctgtctgggacaaaaatgtcatgagtaaaaccaatcctatggttaatattcttgcccagtagttctcttagaatagtcctaaaagtgcttttgtggttcaaagagtaataccttgaaatttttggtgcatgttgccaaattaccctttagaatgcctgttgcttttaaaatattttttcattttagtattttattgtttatccaattatagacttttttacatactcagtagacaacataaagcctcataattactctgttatttttcttttaggcatcaggtacatgaaaaagaagaattcaaggctttgaaaacgttaagtattttctaccaagctgggacttccaaagctgggaatcctattttttattatgttgcacggaggtaagaaatactatgttttgggtctcttaacagaattttttaaattatagcaaatatagagagatggcaagtttggtttttcccagttgacttaacaggaattgaagacaagtttacttgggagcatatagcagggtaaatagcctgcgtttcctaaaatgatggtcggtatctagtagctgcttttcatactacccatttcatattgcttactctgtcctacatcattttttaaaatactgcctgcaatggattaattaccaagagttaaaaacccacaaagaatcttttgttttcaagtatattctgattaaatagtactcacaacatgataactgggaactttttttaaaggaagaaataaaactataagagcctatttctgagaacttttaaaaatatgctgtgtaagacagcatcaggatgatttaaaaaataattcaaaggagtggtgaaaaatctctatgaagatggtgcaaggggtggcctggaaaacggtgcttgttcatgctgccctcagttgaggctagttcctagaaagcctttctggaaatgttgtgagctcttccttaataataggtatgatgcttgccttgctttccctaccattgtcttttcttttttgcttcattttaccttccttttgaaaactcaatctgtgacgttatttggtcagttttactttttcccatttaccatgacatacattcatggtaattgagccttagagacaacatgatacatagagaaaccactgactttggaatctcaaggaccatgtttagacctagttctgctactcattagttatagacttaatctttaccagtttcctgaatttaacagtatttaacatccatgaccattaagttagtagacttacattgttagtcagcttgctggccacaggtggcagtgtgtaggaaacaaatcaaggttgagaaatagtagagagacggtgaaggaagatcagtggaagatgggaaacttgtctaatagggtcattcagatagccttaagaccaagaagtccaaaggactggagtattagggaatcaagaaagtaagaaaattgcattgaacctcccgccacccccctgccctttaacaactctaagtaacccctgctcaccttcccatgaaaggcctctctccagctctcatctcagttgccatttctaaattgcctaagatcattttaattttcgtttgcgtttgagatgaaccatatttgtattctaaccccaacctttaatacaaccaggatatttttacttttccgttgttgtctaagtaaaaagcaaacattggtaagggaggtagaagatgtgtttccccctcttctttaaaatcttattagtttacaaatagcaaagatttctggaaaacaaagctgcgtttttttttttcggaatcagaaactgttatatttgtattccctctctgtggtgatctagaaaaagctaaaggaaagattggacctgctgcagatcccttagtgagattcaatcagtttggtttccatgaaacctattgagtcttgtggcctgagaatgctaagaattctcagctctgctgcttattagctgcataatcttttttttttttttgaaatggagtttcactcttgtcacccaggctggagtgcaatggagcgatctcggctcactgcaacctccacctcctggcttcaagtgattctcctgtcttagcctcccgagtagctgggattgcagacatgtagaaccatgcgtggctgattttgtatttttagtagagatggggtttcaccatattggccaggctggtcttgaactcctgacctcaggtgatctgcctgcctcggcctcccaaagtgctgggaattacaggtgtgagccactgcacctggccttagctgcataatcttagataagtttatttttccaaatctgttgcttcatatgttaaagctggggtatgtgcttataaaaactgtctacctctcctataaagtgttttgtgacctataaagttgtgtaaggagtaaatttgagattttctttttttctttcattctttttttgggggatatggcactgtcagtttcagattttcaatccttttagtttcttacttagacctactggagctcctcctgaccttcattttcacctggtgtgaagcctagctccaagacagatgagtacacagtatatcagagcagagcatccatttactccattatgaaggtcttgtctgtctgtatgccgtcagttttgtcaaagagcacttgggtttgacttctcttttgatattcctgtgtttctgtggcttagactactatgtattaagtaatgctttttgaattgtggattttctaatttccttatcgatggtccacagacgtttcagacttgaaatgtccaaaacttaattcagtatatcttcaaatcaacctcctcttcacaccgtatttctgtttctcagtaccatcatcatcccttctagttccccatctagagaccctaatcattttaaattctttcctcttattgtctttctcattgttagtcaccaaatcttggttttacctgtgagatcctgggcaatcagttaagttgttttagttaggcttttattgcaaagcagtcatttgtattttctcaaggatagtttttaggaaaagcatgaattagcgcagagcctacccagatatagagaactagatggctgtggtgctggaactggctatgctctttgactgtctctcggttttgtgttcaactcttcctcatgattttcatctttctgtatcctttcagcttttgccccagatagtaacccgttcattatctcagtactgcacatctgaaattccagaaagaaaatatgattcagctaaaaagcatctctgcttggcagaaactttaatgttaggttctggccagccagttgattactggctgcccctatgtccagtatgtgctcctggcccagcagtcatgtgattcaaaatgtgaccacttggctgggcgcggtggctcatgcctgtaatcccagcactttgggaggctgaggcgggcagatcatgaggtcaggagatcaagaccgtcctggccaacatgatgaaaccccatctctactaaaacacaaaaaattaggcaggcgtggtggcacgtggctgtagtcccagctactcgggaggctgaggcaggggaattgcttgaacccgggaggtggaggttgcagtgaaccaagattgcaccactgcactccagcctggtgacagagcaagactctgtctaaaaaaaaaaaaaaaaaagtgaccacttggtgctgtttcttcatcaggggctgttcttaggtatgtgttttaattttttttgttttgtttttgagacagggtctcactctgttgtctaggctggagtgcagtggcactaccatggctcactgcagcctctagctcccaggctcaaacaatcttcctgcctcatactcccaagtagctgggacaacaggtgtgtgccaccacagctggctaatttattattattattttttttgtagagatgaggttttgctatgttgcgcaggctgggcttgaactcctgggctcaagcaatcctcctgccttggcctcctaaagtgctggaattacagatgtgagccaccacacctggcctaatttttttttttagttggaccttaatggtctaatattactattacgtaccttggcaatgtctttcgaaaccattttcccccactgctttgctggaactctgtgtcttacctatactaatgtagcattattctcctcctccttcatcaccagttgactacttctaggtaatcttaacatttcttctggagccagtttccagtagaaagcttgtctgtcccattgactccctgtataaagtccaagttctgtagtcaaacatgcaaggtaattttggcctaatgtacttttctaatcttttccttctattccatccaatatacttatgctcttgccctgtggtaaggtagcataatacaaggacattgttgcaacattgtttatatagtggcaacaaaaaggaaaacaatagagttgtgtttcaaaaggggaattgttgaataaatgatgatacatttacattagggaataaggcaatgtgttaattttgcttgttacaagtgacagaaatgcaattcaaatttatgtgtgccaaaaaggaatttattgactcatgtacctaagaaaatcaagagatgtattagtttcttgcatgactagctgcagagctttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaatttcttggttatctaggcctggatcatgtgccccttcctggaatgcagtggtaaagccagccctatccaaattgcatgaactaaaaggagggcatgggggcagggttttcacaaaggaaaattgaattgctgttactagaatgaggcaaaatggatactgggcaggcagaagtagcagaagtcctctacatccagctttaaaaaggcccagaaagatgactctgacacttaccttacaaggtacacgacagtgtgtgtgtgcacctgcacatgtgtatgtgtagactgagaaatgtatgaaagtatacatattaactgttcacattgcttatctcagaagtgtgattggaggagatagaggaccaatttaatatttctgttatctatctctatgttgtttggcttgccaggagcatatattgtttttgtaagaataattaaaaatataaaaccccaaagtggccgggcaaggtggctcacacctgtaatcccagcactttgggaggccaaggcggggaaatcacttgggctcaggagtttgagatcagcttgggcagcatggtgaaaccctgtcaccacggaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaatacattaaaacaaaacaaaacaaaaaccccaagttacaaagaagagttttcctcttaggaatattgtgatacctggcaattgctttttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacccaaacatggctatcagaatgatctggaacattaaaacaaacatatccccagcccccatttccaaaccaaaatctcaggggcagggccttatttatatatttaacaggcactccaagtgtttcatttattactaaagtttgggaatctcactgggtcatgtacttaattcatggtagcacaactagtaagaatcagaattcggtttcaaacctaagccaaagctcttaacaaatgcactattaattacatgcttattactattataattgtatgcttgggtaaatctttgtagatgagcatgaaaacctaaccaacagttatgagatatattactctggggaaaataagttctcgattccaggcatctgatttacaaatggttttttgaaacataagacaagagtgtactcaatataagataatcttgtcattggcgcaatatcattatacattacaaaggttagcagaattggcaccttttcttagcgaaatgacatattactattaacacattcatgaaatatgttaatacagatgaatgtgttattttgtagagcgctttagtttatcagattagcattttttgtctgtttaataaaaaataaaatatagaccgggcatggtggctcacacctgtaatctcagcactttgggaagccaaggcgggtagatcccctgaagtcaggagtttgagaccagcgtggccaacatggtgaaacccctctactaaaaatacaaaaaattaatcgagcgtggtggtgggcatctgtaatcccagctactctgggggctgaggcaggagaattgcttgaacccaggaggtggaggttgcagtgagctgaggtcatgccattgcactccagcctgggcaacaggagtgaaactctgtctcaaaaaaataaaaataaaatacaaaaacaacttcccccataccactccttatcccacacccccatcctctatcccctatcccctatccttcatctctctgtcactgttgctcactcgctctctcactctcatgtgtgtgctctctctcacatacaccacacacacacacacaccccacctacataatttcttctcttacacctttaatataaatatctgagttttggttcagttttgcaaacatttaaaaggcaaacatggtattttgcttgtttcagcatttaataaggtagtgcatacttctttcatatggaaggaaaacatcatattaagttaatatttaaacgtacacaattataatttgcaaaaaaaaatcaagatgataatttcttaaatagtaaattgaaataaatgatattttcctagcatgcttgtcattcagcaataataagaaactgagataagaatgcaggcagttgaagttcacttcagcctgagtgcaagtatacacaaaacagcaaaaatattacatagaaaataaatgttgtccattggattgagtatggtgctaccatttgtcacagtgttcatattcatagttgtggctatctttggggtcactgctgtattcagacttgtcttggaatttggagtcatctagggatttgaggtcattttgagatttgggcttgtcccaggattggtgctaccatttgtcacagtattcatattcatagttgtggctctttggggtcactgctctattcagacttgtcttggaatttggagtcatcttgggactcgaggtcattttgagatctgggcttatcccaggattggggttcattctgggattggtgctcttcctgggattaggtctggtcccgggattcaggcttgacgcaggattggatactgccatagaatttgaggttgttgatgttgaagtttgtccccggaatgttaacaaacatgaagagcaggccaatcggtgatagcttgaacatcatcctcctctgtttcacaataattatataattttaattgaacacttggatcacaaataggcaagcatatatccttaattgtgtttatcagtacatttgtgttatgtaaatgtttgctttttcactattagtgaacaaattaaaagcttccctttctttgttgtcaacatctgctgacacaagacctattttctattgagggctaccaactgaaggcaaaaacaatcccaagactgaaaaagagcttaattggcatttttctatttaaaaaaggaaaaaaataaaactctagacattcaatgcaataaatatgggggcttgagatcagtatagagtagggtaggggcaaagactgagaggcaatttgggacagtagagcaacaaaagaaataatgaaataaatattggtattttcttgatttctcatgacctttattccaacaatttaaggttttagtttaggtcacaaattaggatattacttctaaatatttacccaaagactaaagaggttaaaccaaagcatttccccagtgctgggatgaggttttcttcattaacaacaacaacaacaacaataacaaactagagaagttcatagttttaagatttagaaatgaacaaaaccaactccttcattttgcaaatgggctcagacaaggggcataacttacctgagggtgcatatctaaaaatgacccaagctagaacttaagtctgtgacttaaagcccaaattttaactgtagaactctaacatatatattaaaagttacatttggctctaatatgtaattgagaacatttcaaattaatgttaccttttgatatttttctttgaagagtaagaattcagtctttctccagcgtctatggggaatctgatttctcactcactgcatgctatttaaatataattagtgaggaagtcatgtgttctaaacttgacctgccatttgctctttggaagtatccaactgagtgtttccagacaactacatataaacagatagactttggcagagattaaagaattcaaataaagttctaaaatctgcttgctaatttaaagaatccagtgaatagcatttgttattcctcttaccatgtatacattaatgaattgcttcactggattgactctaactagatgaatttactattttgcctgctgtgattattatgattttaaaccaagtaagtgtattaaaggtgtctgcgttttccttagaacatctgtacatatgtttatagggcagtttctacccatggttattttgaagtttaaaaaataattcagtaatacaacatttcaggtatttaatttttggtaaataaagtaaccttagaaaagaagttaaacttcattaatatgaaacttaagaaaaggattacatatgaaagtgatactttttcatactgagtttacaaacttttgtgtgtttgtgtatggttttttaatgtattaaaccagtcaccttgaagtgcataaagtaaattttttgaaggaattttgtcttttggtcagccgttttccatgataactagcatatagggaaattgggttgtattctgctaatgttttcatcatattggccagcacactttaaaaattgcaggactgtgaacaatggtgttgacatacaaggaaattgcaacataaatggcagaagtacaagccagtacatgttcctcacttgttttactgtgctgtgaagatcatttttcccctgaatgaataaaccatgaatagaaccatgcttggtaaatcttatttatatggtacatataataacttcacttaactggaggttaatgtggtcagatctaagaagtaaacaaacaaaaaaaaactacttggcaaccagagtagatattatgaatcggagtactgcagtaatttacaggagtttgtcattgtcctctctctgctcacttgctcattctgtggatttctttggggggtatatagttggtaatagtaatagtaatagtaatagtaatagtaatgtttcgaacttgagcaaactgtgacttattctatttttctaatcttgaccttttgagtactacacttacacaactctttattgatgcttcaaacacctcagtctcaacttgtttaaaattcagaagttagtgttttctccttcctatttttgtatctagatatattcttctcataatctcttggttaattgtatcatcacctagccaaatgtttctccaacactggatttctcattatcttctctttcttatttatcttaagctctccaggcctcttcatgatgattaagtaaaatttaaattctatttagtactcaaatgttcccaaacaaacaatagtcaatttgccattattcaggtcttcaaatacccaccaactttgtatctttgtgcagcctccccaacttgcccaaagtgtaataatagccccctcttatcctaagtttcactttccatagtttcagttacccatggtccaccatggtctgaaaatactcaatggaaaattccagaaataaacataagttggatgtatcatgaggttaatagtagcctagcactgtgtcacagtgctgcattagtcaacccacttcatcttatcacataggcattgtgtcatatcacatcatcacaagaagggcgagtatagtacaataagatattttgagagagatgccatgtgcatgtgcttttattgtagtatattgctataacttctattttattattgtttttaatctcttactgtgcctaatttataattaaactttatcacaggtatttctgtataggagaaaaacacagcatatattgggttcaatactgtaattctgtggtttcaggtatccctgaggggtcttggaacatatcccccacagttaagggggtactactgtactttcctcattcaaaattgtgttgtttcttcaagctccactcatgtcagcaccttttatacgatccttccctaattcttcacgtcagaatcagtcattttagtactttatactttgatcagagtctcattttcactaaagaaactaaatcttccaccatattctggctttttttgtggtaagataccacctcttattccttctattccctctagcttctaatatagtgagtgtttataaagaataggacacagggccagttataaagaataggacacaggctcatgcctgtaatcccagcactttgggaggccgaggtgggcagatcacgaggtcaggagatggagaccatcctggctaacacggtgaaaccccatctctactaaaaatacaaaaaattagccaggcttggtggtatgcgcctgtagtcccagctacttgggaggctgaggcaggagcatcgcttgaatccaggaggtggaggttgcagtgagctgagatcgcaccactgcactccagcctgggggacagagcaagactccatctcaaaaaaaaaaaaaaaaaaaaaaaaggggcacaataagtattggaattcattgaaatacctcctgtttctccatgtcggagggctggtatcattaatgatgtctaaagtaagagttatttggttatttgcagttttcccttcacattagcataaatttggaaggcacaggcttgagtttaactttcatctctactttcctggctgctgttttgagaagatttcttcatttgtacaatgtggatcataatgcacattcataatcccttgtctgtaatctgaaaccccaaatcctccaaaaaccttaagttttatcaaaaaataaaaaagtttgacaccaaaatttatttggtgcaaatgccttatctgcatagatgggaggtttttagctatctttgtttcacttagtgtggatattaatgttgcgctgcagaaatattgatgagattgattttggggtgctgttccattttctactggagtgttacataatacatgataagaatagtacttagcatattcatgtttctcttcttccttctgggcacagcaccataccactcttagcattctgatagttaggtggtaccatctgactgagttctggccagtaaaatgtcagttccaatgatgtacaatcgacccttgaacaacactggggttaggggcactgaatctccacgcaatggaaaatctacgtataacttttgcctccccaaaaactaaactactaataagactgttgatcggaagccttttgataacataaacagattaacatgttttgtaagttaaatgttgtatatgctatattcttagagtgaaataagctccagaaaagaaattgttacccagaaaatcatgaggaagagaaaatatatttactgttctctgagtggaagtggattatcacgaaggtcttcatcctctttatcttcatgttgagtaggtggaggagaaagaagagggattggtcttactgtccccgggctggcagaggtggaagtaaacctctgtataagtggatcagcatggttcaaagccatgttgtttaagggtcaactgtatatgatttttaagcctgatgtctaacttctcaccaatcttccattcttgctttcttctatcaacgcctactagaaacagacggttcagtggagggggtctccaagacgccagaagatggtaaaaccattagaaagcatgatttaagagaaattaacttttgttgtcttagccagtgatattttgggattatttgtgacagaaattagttcgtgctgactaacataactacatgctggacatcttgcctttgcctcttcaaatccactctgttctttaccctgctgtgtaccctaagaggctgacctgtgtagagggtatcattgggctcccctcctttctggctttcagctggcccatagggaatacaagcggaagattagggagaagaaagagagtaaggttaggaggtatatatttttggctccgtttctgcagggtcccagtgggctggctacatccatccatgcagtatggtttttgttgggtgaccctctccacacaacctactctgtgtctgctttctgctaactgcttcctgcactcactacttcaggtgtagtatcacactgtctcttaagagtttccttaaaacctgccttctcctttatacataatctctaatatctcagtttgaatttgccacctgtttcctgctagaaccttaattgctacaagctgtatgtacactgtatcatcttcctaaaatcaccaggcatggtgggatgtgagctatagtcccagcaactcaggaggctgatgtaggaggattgcttgagcccagaaattcaaggctacagtgagctatggataccctaacctgagcaacagagcaagaccttgtctctaaaaaacaaaaattaagttaaaaaattgtgtctttctttatatacttacattactttccgttgatctgtttttgaaatgtttccagaactgtcttccctcacgtattgattcttccaaaattcttaagaaaatggaaaaaagtaatttctgaaaatgatgagaatgatcataaatttcatatagcactttcttgagaatttcaaattgcagttttaatattttactttagaaacaggtccagttttcccttctgtaatttttttctttggtctttttggattttttgggttttttttttttttttttttttgaaaagaacacagagatcttttcttgagtgatatttgcacagacattgccttggtaattgaagcttttttttttttttttttttttttttttttttttttttagaaaatcctattaagttttatgccatgtctatgctcattgcacctgtgcctcatgtctcattcattcattcgtttatttttttattattttttttttttgagacagagtttcgctcttgttgcctaggctggagtgcagtggcacgatctcagctcactgcaacctacacctcccagattcaagtgattctcctgcctcagcctcctgagtagctgggattacaggtgcctgccaccacgcctggctaattttcgtatttttagtagagatggggtttcaccacattggccaggctggtctggaactcctgacctcaggtgatctgcccacctcagcctcccaaagtgctggaattacaggcgtgagccgccgcgcctggccttcatgtctcttttaaataggacttctaaaattttgaaatgaggtcagcttcagtggctcatgcctataatcccagtgctttggaaggccaaggcaagaggatcacttgaagccaggggtttgagaccagcctgggcaacatcatgagaccctgtctctacaaagtacatttaaaaaaaaattagccaggtgtggtggcacacacctgtatagtcttagccacttgggaagctgaggcaagtagatcgcctgaccccaggagttcaaggttgcagtgagctatgttcccaccaccgcacttcagccagttaaggggacagagcgagaccctgtctcaaaaaaattttgttttgaaatgaatttatgtatgtttggttatttctgaaagcagttcaggcctacagccataccaccctgaatgcacctgatgttgtctgaaagcaattcaggttttcaggattaaaatttttatgctactaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaaaaaaaaaggaagaaactatttgggagttttgtgaacaatggatatgcaaaaagacaggccattgttatgagaggcctaattgtgagtaccttctagaattgtatataagcatgattctcttcaatagtaaaatctcagcctcttcattttagaaatctaatataggaaaaagaacacatttctccatagttgtaaaacataggttctcagggtgaatgcccatctttgagcaagtttgtcttcctaatggtataatactgtaagtctgttatctaattttggcttgttgtcacttatttttcataatcaaagaaaaatgatttaattttaaaaagatgctctcctttctgttttcttctcttggatgatagtatccctatctgtctgagtttatagaatcttaatttttacctgctcttaccacatacatctgattagtcattaagtcttactgattctgcttcagaaattttgttttatgcttcactctcatgctaccaacttatttggtagcttcagcagttgtctaagctggggttggcaaattttttctgtaaaggaccaaatagtaaacattttaggctttatagcccatataaagtttttttttaattttttttttttttaaaaaagaaagaaatgtaagaacccacacctgtaattgcagcactttgggaagccgaggcagggtggatcacgaggtcaggagttcaagatcagcctggccaacatggtgaaaacccgtctctactaaagataaattagctgggcgtggtggtgtgtgggtatgtgcctgtaatcccagctactcaggaggctggggcaggagaatcgcttgaacccgggaggcagaggttgcagtgaaccgggatcgcgccactgcactccagcctgagcgacagagtgagactctgtctcaaaaaaaaaaaaaaaaaaaaaaaagtaagaatcatacttagcctggaggccatacaaaaataggtcacaagcaggctgtgggaaggatattgtaagtgggccatactttgctgacctctggtctaggctattacaacaatttcctaattggagtatttgtcaccggtattttaccccggtgtaagattgcctccatcttacacattactgccagaatcatctctctgaaatgtgaccatttcacttccaggtaaaatctttatgtgctccttttagctaagttttcttgcttaaggtattcatgtattacttcggggattttttttttttttgccatttcttcataaccatctatattatttattcagtatttttatagacttttttttcttaaaggaaagtttatactgtgaatggaaaatcaatattgattgccataactagaaaaccaacaaaaggcaacagtaaaaggaaatatagaactatgaaatgcctgtttcatgtagcacccaatcatatatgtactacatttcaaaaagtcactggcttataaaaatattttttagcatctcatacaagtctcttcataatctgttatacagctcaccttacttgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttgatccaagaagactctaggagctggctaagccacaaagtctgcccaaaaagctcagaatgacaaatgaatgttttgtacattatctccactataatgctagaaaaaagtcttaaaagcatttgtctcaattgatcatttatatggaataatactggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagtttaaaaaaaaaaaattcattgaaatgaaattcaccctttttgaagtgtacaattgcctgggcacagtggctcacacctataatccctgcactttgggagactgaggttgggagagtcacttgagtccaggagttcgagaccagcctgggcaacatagtgataccctgcctctacaaaaaaaattgcaaaaattagctggatgtggtggttgatgcctgtagtcccaactactcaggaggctgaggtgggagaatcacttgagcccgggaggttgatgctgcagcaagctgagatcaagccactgcactccagcctggacaatggagagagaccctgtctggaaaaaaaaaaaaaaatcttttttttaagtatacaattttgggccgggcgtggtggttcacgcctgtaatcccagcactttgggaggccgaggcaggtgaatcccgaggtcaggagatcaagaccatcctggctaacacggtgaaaccccgtctctactaaaaatacaaaaaatcagctgggcgcggtggcaggcacctgtagtcccagctacttgggaggctgaggcaggagaatggcttgaacctgggaggcggagcttgcagtgagctgagatagcgccacagcactcaagcccgggtgacagagcgagattccatctcaaaaaaaaaaaaaaaaaagtatacaattttgcatattcagagttgtgtactcattaccactgtctaattttaaacattttcatcactccaaaaagaaacctcatagccatcaacagtcactctcccctttcctcctgccccccctcagcccctggcaaccactgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacctgtagtcccagctactcgggaggctgaggcaggagaatggcgtgaacctgggaggcggagcttgcagtgagctgagatggcgccactgcactccagcctgggcgacagagtgagactccatctcaaaaaaacaaacaaaaaaaaacactaattaccagtttttttgtttttgtttttttgggacagggtctcactctgtcgcccaggctgaagtgcagtgacgcagtcacagctcactacagcctcagcctccctgggctcaagtgatccttccagctcagcctcctgagtagctggaactacaggtgtgcaccaccatgccagactaatttttgtatttttttgtagaaacaccatgtctagctgatttttgtattttttgtagagacagggtttgtcatgttgcccaggctgatctcaagctcctggactcaaatgatccaccttggcgtcccaaagtgttaggattacaggcatgagccaccttattaggcctaattaccagttttaattatagacctacatgactacggtttgaaggaaaaagactttatttaatcctagtgattggaattggaattctcatttgagccagaagatttcttgagtggttttgttttctgtgataacttggtttatataagtaatccacattacttgggtgttagtggtaaagcaagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctaatttttgttttgttttgttttttctttttttttgagataaagtctcactatgtcacccagcctggagtgcaatggtgagatctcagctcactgcaacctccgccccccaggttcaagagcttctcttgcctcagtctcccgagtagctgagattaaacagtcatgtgctaccatgcccagctaagttttgtatttttagtagagatggggtttcaccattttggccaggctggtcttgagctcctgacctgaagtgatccgcctgcctcggcctcccaaaatgctgggattacaggcatgagccaccgtgcctggcctaatttttgtatattttatagagacggggtttcgctatgttggccaggctggtctcatagaactcctgacctcaggtgatccacccacctcggcatcccaaagtgctaggattacgggcataagccactgtgcccggccaaaagtttttttgaatcacctatggttcatttatttcagtttaagtgtataatcctcaaaggaaataatccattgggatgtatttatgaagtttaagtctgtaaaacaatgtggaggccgggcgtggtggctcacgcctgtaatcccatcacattaggaggccgaggtgggcagatcacttgaggtcaggagttcgtgaccagcctgccaacatggcaaaaccccatctcttctaaaaatacaaaaattagccgggcatgctttgcgcgcctgtaattccagctactcaggaggctgaggcaggagaatcgcttgagcccgggaggcagaggttgcagtgagccaagataatgccactgcactccagcctgggtgacagcatgagactccatcttaataaataaatagccaagtgtggtggcacatggctatagtcccagctacttgggagggtgagacaggagaattgcttgaacccggcaggcagaggttgcagtaaaccgaaatcgcaccactgcactccaacctgggcaagacagagtgagattctgtttaaaaaaaaaaaaaaaaaaaggaaaaattctgaaacaaccatgtaagaataaatgcatccaaatgaacgttgttcatctcagaagagtcacctttggaggtgatgcacttagttccaactttgctgcctttgagcacaacattttagggaaataattttttggaagtgttgtcaaagtctgaaatacattcttgtagaatgtggaaaatctcatacttgaaattttttgataagcaagacaaaatgtcacgtttagtaatactgttttttgtttaagatgaggtttttctgctggacatgggggctcacacttgtagtcccagcactttgggaggccaaggcaggtagattgcttgagcccaggagctcgagacaaacctaggcaacatgatgaaaccccatcacctgtacaaaaaattagtagagtgtggtgatgagagcctgtagtttcagctgcttgtgaggctgagatcggagaatcactttagcctaggaggtcaaggctgcactccagcctgggtgacagtgagaccctgtcttaaaaaaagttttcttatgtaacttacaaactagctcttagtggtatttgaaaggaacagccccagagttgttttcagtaacgatggtatcattggagtaaaagtatagcgatccaacctgactactttgaagaaataatacagaaaatgaggtgtatcatgtgtgacatttatgtttaaatttaaaatcagtttatagtcaactcatagttaatatacgaatattttttactaacttcaagtgattccttgatcctttaaataattttaatatgcttttttgttgttttttgttttgagatggagtcttgctctgttgcccaggctggagtgcattggggcaatcttggctccctgcaacctccacctactgggttcaagtgattctcctgcctcagcctcccgagtagctgggattacaggtgtgcaccaacacacccggctaatttttgtatttttagtagagacagggttttgctctgttggccaggctggtctccaagtcctgacctcaggtaatctgcctgtcttggctcccaaagtgcttacaggcgtgagccaccacacccagcctattttaatatgttttaaagagactttagcttttacaaggtgtctctaagctcatacttaatgacctgcagctttttttgtagaatttaaagtcaaggcaagagactcataatactttatccaagtatattttgttaaagcaaaaaaaatgtcatgtgatcttgtggaaaagccataccatgaggaaattttagctcctataaataggtgaaactatttttaaacaattgtttgctttcttagattatttgtcattggtataaggaatacagatgagtatttaatgtctaaataatataactcataaatggatgtggttgtatgccagttactcttacactacataatatctcaaatgtgataatggttgctgaggctttggatggcaaattagggctttcccagtggttattgtggtgtatggcatccttgtcttcccttacttatgttttgtttttcttctttctcaatggaaagccattaagtcttagttaattttctgttgaggcaagcatttgacattcattcgaattccctcagccttccagaagcattcagtatgtttcaactgtgactatgagcaacaaaataatacaaagtgaaaaactgcgtttcctggtgtgagtatttcattagatttattgatccttggccttatggtatccatgtgaaatgttcagacatctaattttttactgctaaataatttttttaggggataaataacaaaccttgtaaattatttgaagcataactgaagatgtcagatatatgagaaattatttactattactgtttcagtcattttcacttctaatcttgttaactacccaagaatctcttgtacaaaggatagtaatcattaaaatggttatatagcacccacaaagtgctttaatatacatgttttaatctattccttaaaacaccttctggagtatatgttcttaaccatattttttatcagaggacacatttaatcacttgcccaaggtaaaaacacacaccgtaggtgataaactttatgtcatgctctgctgttaaaccaccaatatagttagaattattttgatcagacaagagcgaagcagttttcctgtttttagtgagtgcgtatgtatgtttaatttctgtgctttgatctcattcataactgtgtgtgtgtgtgtgtgtgtgtgtgtgtgtgtgtgacacagggtgtggctttgtcacccaggctagagtgcagtggcatgatctcagctcactgcaacatccgcctcctgggctcaagccatcctcccacctcagcctcccaagtagctgggactacaggcacacgccaccacacttggctaatttttgtatttttttgtagagacagggtttgccgggctcagagctcaagcagtctgcccacctcggcttcccagtgtgctgggattacaggcatgagccactgctcctgggctcattaataacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctacacattgtgcacatgtaccctaaaacttaaagtataataataataattaaaaaataataaaaataaaacatagttttaaaaatacaaaaaaaataaaaaataaaataactttccagaaatttagattcagaatctcaggtcaggctttctagataaggataagtgggtatgttgagcatgtgtctcacctggctcttaaatatgtttaacaaagttggggctgttgaaccaaactgacatttcttaacagttgatcttcttaaagacctcactttgcaccacagttttctaaatgtgaaacatactaatctgcttaacacattattaacaccttaacatgacatttgtttctacttctcttctaacttcccttgagcaattttctatattgaattgttcatgggtatcagaattaacctttctctagaattgttccaaaggtaactccacattgcccagaactagttttttttgctttgttttttttttttttttttttttttggagtgggagacagagtcttgctcttgtcacccaggctggagtgcagtggcatgatctcggcttactgcaacctccgcctcccgggttcaagcgatcctcctgcctcagtctcctgagtagctaggataataggtgcctgcccagctaatttttatatttttagtagcgatagggtttcaccattttggccaggctggtcttgaactcctgacctcaagtgatccacccaccttggcctcccaaattattgaggttacaggtgtgagccatggtgcctggcccagaactagtttcttatatgactagtagtagcctagccaaatcctccctcattcttaacttttctttgatctttcttttctcaggactttgaagctgtaactttgaaataaatgaaagaaacttagactctagaataagactcgcaggtttgacttggtctgtcctaagtaggtcattgttagccaactagtcacatctttgatctatgttaattcattcttttatttataaattcagataaaggtggtcaaaaaaacaaacttctaggggcaagtgaatgtctcagctgaaatcaaaaggatgagtagggtttgagagggcaagaagagggagagaggacatgcagcatctctgaaagcctggtggcacgaagcatggtgactaagggacagaggatattttgtttgtttgaactataaaatgttagagagctggaaaattttaagatgatactctaaagggaagcaaggccctgatcatgcagtaaaccatattaagagtttagattttattatgagatatgagaaattattgaaagggaagggttggtacacagttcatcttgtgtcttcttatttctcttgttttcttactcagtctagatgccctagacaaacatttcagtagttcttttcttagatctcttggctatttcaaggacaaggcaggtaataaaatatgcttggtctacagtgttagttagcattttggcatttttctttttgttactttttaatacatggttctatgtcctataattttttcttatttttctaatatttgcgttttccacatttcacactttaaaaaactcttcataaatatttttattggccagatattctggtcagtgggtcattgtttacttaatttcctaatggtggatatttattgttgtttcagtttttcttgttagaaagaatgctgtgatttacctataggcaaaagtttaaatgccttaactgtagacaaaagttaaaatatcttacttttttaaaaatttcattgccaaattgctttcccaaagaattgtgccaatatgtgaacatggccatttcattctaccttccccatcgttggttttttttttaattgcttgctattttaatagtgaaaaatgatgtcacatttttattgcatttctcaattacgtggttggccatattcccatatattaatcatagtattttgtatcttgtaaacattctttttatgtcctttgcccatttattcattgagaattttaagatttttttctcatccgttttatgagctcctgattaacaacctcctttatagcatcttatttgaatatttttatcaggctggttgtttcagcataatggggattttgtatagaccaatctattgataatttctttgtgattgtttttttttctaattaaatagccttccacctgaagacttacaaatatttttaaattcttctgctggttttatgacttccttgttcatgttttctttcactttgtcagtgtatcacatgaagtgagtgttaaactgaacttttttccaatttcctcatctcatttattgagtcttttcctttcccctttggtttctgatttttctttccacagctaacaatgtttgagaatttactgtgtgctaggcactgttctaaacactttatctgtattatctcattttcttctcacaacaaccctgtaaggaaatagaggcacagaaacctaatttgctgaagtgacacagctagtaagtaaagctttgtcacatattcagttcttctgtgtacctgtgctctcattgtgctgttgtttctatattgtggttatctttctgtttttatgccactatcattctgtaattattatggctgatacatgtttctctctcaagaaaagctaatatcggccgggcacggtggctcacgcctgtaatcccagcactttgggaggccgaggcaagcagatcacctgaggtcaggagttcaagaccagcctggccaacatggtgaaacctgatctctactaaaaatacaaaaattagctgggcatggtggcacatacctgtagtcttaactactcaggaggctgaagcagaagaatcgcttgaacccaggaggtggaggatgcagtgagccaagatcgcaccactgcattctagcctgagtgacagagcaagactctgtatgaaataaataaataaataaataaataaataaataaataagttaatgtaactgtagtatttacttctttttctattcttgcttgtttctaagtgaacttaaggttccaaaacatttctcattggaatatttttcagaattgccttaatctgtaaactatactggaaataattgcaacgtaatagtatcccaccaaagtcctctgtaccttagtgtttgatatgttccaggtgctgactaaatatttgttgagtgaaagaatgaatgaatgaatggagagaccttagtttgtcatctgcatcaagtcttaatttatacttctcattaatatttttcagattttccccatttgatgctgcatatttcatgttaatgttacttcttgacattgtatatttttcccataattttctaattatttgttgccaatatctgttatttctgtttttttgttttggaatttcccaaatattgttaaaaaagattggcaatagtgggcatccttgtttcgattgtgattttaatagaaatatgttattcttcaccagcaagatgttgggtggtagtgtgtaatacattcttttatctagttcttaaaatatattttataaggaaaaattttatgaaagattttaggttaactcttgactgacatttttggtattaaaggaatttgctgttgtttgatagcatcattatggaagatattgaatagcacatatttgtgatcttttaagttagctatagaagccatcttctcattctgctgtggtaagtgaatgtctttctgactttcttctgggtccctatttcactgatatctaaacctgatttctagcagggaagagactaaagcaagcacatcctttcattcccttgctctcagtgtgtagagctgaaatgtttccatatatgggaatttctcatagcattgggtttggacatacagatgtgataataatcctcacaacaacaacattactgcatctaggaatgtgggtgggccaagacactgtgaagggtttatgtgaattatgtcatttaatcttcagaaaaaaaccactgtaagttctgccagcccattttatagatgaggaaactgtgacttagagcagtgaaataacttgtctatggtcatacagctgagaagtggcagaggcaagttgcttgtaaagtagagccaagccttagagatggatgggtgaagatagatatagatgtatgtgtatataggtatgtgtatatctgtacacatatgcatacatatttgatgtgcttgagagatagatgctaaggactaatgcattttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaacttagagtctgagtagttgacgtatattgtacttgtaagtttaccaagtttgactctgcattttgcagacatgtctgtaggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtctcaaaaaaaaaaaaaaaaaaaaaaaaaaaaaaaaagaaacctactttctgtgaaagtcggtgtatatgtttttttaaataagacacaagtatgtggtagagtagggattatctaagcaattagtccctatcatggatggtgaaggtactaatcagtgtttgggagggagtggagatagcttccgtatatagagaggtaatgcattttaaaatcatttaggggactttttcaaataatcctgtttcttcatggtgagattccctgacacagtgagccaatcaggtttgctaaggcagaaaatgttcgagagccactgtactagacagcatgaaagatgactgttttgttgaagcttaatggtaatttttccataatcctggtccttaaaaagcaaaaaaaagaacacattagagtgttgttacttttctctctctcaatagaaatgttcctaaaccagcaaaggaggctatctgaatttttaaaagtttttacgaaggaacataaaaattcctttctctatcttttcccacctctagaaatgcttgaaatgagattctgccttacgtctcacaaattaaataccacatttgtgtctcacccatctcagttatgctgtcttgcattttaatcaatcctgtttcaggacttcttttgctgccttgtggctgtttcttatgtttgtcactaattcataagttggctaacttttatatttgtagagaatttctcagtgattttcttctagttggagttccagtgtggtttgatttggagtgtcaagatctctgtcccatgcctagccttagtcctcagtctgttttactgggttcaccacctggttgtagtaccaaatgcccttttccctttccctctctccttcctcacttcctcagtactgcccaagttcgtcagacccaatgattttattcttaagctaatcttatttttaatttaggtaattctgatttctgatttgtaaaagataaattttcttctccttcatgtagtaggattttaattttgtaaatatttaaattctccattaatggtgtgttaaatctgcactaaaactgcttctttacatgtttttaaattttttcattatgtttttaacacttttcttacatgcaaaaaacacaaccgttaaacttttcttattaaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctgctaaagttggtatgactggaaagccaaatgacacagttatgagcatagaccttttattttccagatgtttgacagtgtaaacatacataaaatacatattaaagtttagatgctttatattttgtgcaataaattgaagccttaaaacatttcattttttttataaaagaaactcattagtttacttaattaagacagtaaaatagcagcaagtaccaagacattgtgcatttcttttatttaagacaagttacttcatttacatcagagttagaaatgttaagactggctttcttgaatacttaaatatagctcgaatcactggttagatatggacatattttcccaactgtacatcagggaggagtgctttcattagtttcagaaaatgcagaccctcagacagccagcatgaccacaacattgagcaataagagaaatgaagcatttactttccaagcatttgccacagaaggtaatggagtctttacatttgtggttgtctcttccctccataagttaagggttgtgctttgttgaggcatttcagagaaattatttggcatgccactagtgatacttagggtcatgggtgttggggatgattttgttgagctagtgaggcttgtgtttgtgaccattccatcttggagatgaatagttagagttgcagctgctgcttcatgtgaattgatagtctctgtggatgtatcttctggatagggcacaaaagccttatcagtgctagtaaaggtggtgtctttgcttagagtggcaccaaacgttgtttcctttgttcgatattgtttgggtattttggtcactttgggttgagttaccacactcagagagttaatggtgtccactgtctgcatcccacttacagtgaataagcttgaggtaaatccagaaggtgtgggatacatgttatgttcctttaaagatgatatttgggtagaacatggagtccctatcacatgggcttttgtttccatcatccacttcagtaagtaagtaatgttttgtttgtggtcacatgaccacctgttattgtaaagggttatctcttgcaactgaaagagttggtcaaaagattggtctggaatgaatgtgaacttattgttgtgcaggtaaagatgtgtgagatttgtcaggtttattaatgtacctggaagaatttgtgtcaaagaattattagacaggtccacgatatgtagtttggagggcatgttggttggaactgtccaaagtttgttactactgaggttgagaacctcgagacttcttagtgtatttttaatgaggacaaccttttccagcatgttcttagaaacatccagatatttaagattccactgataagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataccaggtgtgagaaacagaaggatgaacaggcagagagacattttcaatatctgatattccatcaaagcctagaaacaaacagatacacccttcttttaatatgcaaatacagtttaggcatctgcatgggtcagttagcattaggcaaaattttcaataaacctcgttgttgtcgagtccttttataattgttccagtgattaaactaacaaagctccccttcatttatagtccaaatgcttaatccttcaattgggctatgtggtagagagagactctctccctactctctcctgcattttctcctttattttctctctccctccccccttttctaaccatattctttcttatttatctttctagagccttaatatgataaaatagcattctttgcaaataaatagttgcagttgtaggctattactatttttgatgatatgctttcttactcagatgagaaaaaatggctgtcgtgtcttttttttttaatctctgcagtaatgtaattcaatgtgtgtatatagggtagattttatttagatattaaagcagttcttcgaaattttatctgtatgtttttaggataaatatatctttgtaaaaagcacttgaaaaatccagaccaacacagtacctataaacctcacattttataaagtgatttttttctgtatatttcagtgcccattttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggataccttatgcatgagagttggcccttactcctttctatgtatttgtctgagattgggttccatattttaacatttgcctcattaagaatctgtgaatttttaaaatacctctactctttatcctttttacatgttgaaaataaatttgaccttcctcatggatagttttctatgatattagtcccactattttttaactcctgcctttttatattcctttctaaaattgtataattttcatgtcacttttttaatattataaaaaatctgttttatgacttttatgtcttcccccaacatggtgattattatgtttaatcagcttttcaaatttatcaaccacttaagtgttccgtcttcccttttaggatgtatagaagtactgaaatacgattattttttctttatctttctgatacaatgatcatttgaccaaggctacacacaagccaggatacatttggaaattagcatcttatacttcagattatcagttcctatgtaaaataaacatgttttattttatatatttggagttaaagttttttttctttatgcaaccttgggtggtaagtggatatgagtattgttttttccaaagacatttttggtgctgtatgaatgaccatttatttgattttatgttttaagaatagcagtatcaatttaggtgatttcagagtgttgcacatttcatctttctgggaaagtagtttatagttttaaaattacatgaaatgatataaaaggaaaatttttcatcatgagttttataaagtgagatcagatttatgataaattttgctccactcttcagtggactgcttgtgtaaatctgttaaaacacaaatctgatttccagaatggcaagtttaaagaaagcaaataaagttacggtattttcgttaccaagtggcaccatttaaaaacgagtaatatttagcatgttatgtgtaaggaaagtctctttatgccttgttactaaatcgtttgtttttctctaaattatattagcattatttagattataccacaaatagaatttgttgtattaaaatttgaagtttattttcttacaagagaaactatactctaggagccaccttttgtataaaactaatgttcctcgaaaagtatctgcattttaagagtccgcaacatagaagtttattgttgattgggtgctttattgccactttactttgagggttcagttgaactctcaattggattcttactgtggatttaggaaaccagccatcaatcatagtgcttaaaataatgtgttaaaaatactacattcagcaatattgtggaaatagggaatgcattgacatttagagttctatttaagctcatatatacactgctgcacttctaaagatgtgactgagggtcaatttaccgaccacttaaatctcttaattttaggaaacctcattaagtcagtgtagaagtagagttatgcattttcattacacttaacagtacttttgtttgaaagaaaagacatgttacttcattaatggattcaaatgaatttgggtttaggctgtatcaagtttagtttctgttgtatataatagaaaattccagtgcaatagtagtggcaatgtttctcatttcaagtttgggacataccaaattgcttcatattattcaaagattattgtaaaattctcaaaaagaaaaagggagatcatttcaatatatttgaattctaacaatctcttacactgggtgcagcacaccagcatggcacatgtatacatatgtaactaacctgcacgttgtgcacatgtaccctaaaacttaaagtataataaaaataaataaataaataaaagaaattctcatgaaataaaataatactgtattactgttactcaaaaaaaatattttttagaggcataagtatgtgttacaacttattttaaatattattcagactcattacattttctattaggctgtctaggtcagtaatgatagttaggcaacttttacattctagattaagcagtaaattaatttacgtattcttttgtgtcctaggatatattaccccaacattgtgaaaggtatcacaaagcatctgccaaggaatagctatcccacgctaatcagtggtttcagttttccattattataggtaacatttgctatgcttgagagtcagatattgtttatttttggtaatatggttggctatttagactgattttcctgctgaatacaactgagagtactcaataaagtactttaaaagcatgaaagaaataacaacatagaaattaccaagtcaaaatccaaatgaatcagtttctttgcccacctccctactcctttttttctttatgccactggcttgttgccaaaactcagtcaattatttcctaaaatgtctctcatcttggagttttctctttgactctttgggaagatttaatttgttcttctgtcccccatattttctataagtgattcctcatatcattgacataattgctcatttgcatcatctcacaataatttcaaaataataccagtattgattgctacaattagattatagactaccgaataaagtttaaaatttgtttgtagctctgcttgctttattttactaaaagtgtatagtaaattctgtgttctaatgcaatgtgaaataattcttttctgtgtatttttatatcaccaacttgatataaactttgtttcagttttcagcttttcaggatcacaagtcaaaattatatatataacaatgtatattcagataaatcttgcttctctgtcttttccatcctatttccttccttctgctattagtaactgtttttattagtttttcgttgtatcattaacatttctttttgaaaacctaaaaaaaatgtaagcatatgtatggtatgttcttatccccccttctaatataaaaggtgacatatatacatactgttagataacttgttcttcttttcttactgtatcttgagtatcactccatatcagtatataggtatctgtatgattcactgtttgatccatagtactccatttgggaatgtaccatggcttattcaaccagtcccctattggtggacatctgggtttttcagacttttgctgttacgaataatgccacagtgaatacccttgtacctaaataattttatatgtttgccagtaaatctttgaaaaagattcctagaagtaggattgctgggtaaaagggtaaatgcatttggaatttttccagacattactaaattcctctccattgattataccattttgcagtcccaccaacagtgtatcatggtgtcgagttctatacagcctcactgtatactttgttgttgaactttgggatttattgtccatctgataggcaagtatctccatctaattttaaatgcatctctgtaattatgagggggagtatatgtctttacatatgtttaaagaccatttaaatgttttctcctgtaactgtctttttaatgttttgcactattaaaagttgtgttttgggtcttccccttcctgccccatattaggagcattttaaattttagaggtattagcactttgtcttgatttaagttttaatttttttttccagtttgccatttgtcttttggctttattatggtgaggtgtgtgtgtctgtgtgtaatgcgcacttgcatgtgtgtgatatttaaaagtttcatataatttgatttccctttttattgcctctggattttgagtctcagctaggaaggttttttcccgcttccagattataaaggaatttactcatattttcttctattacttgtataatttcatggtttatatttagaactctggtccttggtgttccaatatagtgtgaagtatggatcaaattttttcttttttccagatgtctatccaattgttccaatgcttgtttccactgatttgatatttatttctggactttttcttctgttccattgatctgtttgtttagtcatataccggtaccacagtgttttagttataggttcccaaaggtgctactttactttttgatcagaattcagtaagaacaacagttaaagatcaccctcatctaattcatttgtgtccctcaccactgacaccaaatagaagacttatgtgatatatgtatgtttcagtgcatgatgtaggtgctctttggtcctatattagtgaaaagagtgttgaaccaatagtcagggagcaaactcagcttttaataccacttctaagcacatcacttactttctctggtcctgttttctcagtagttaacaaacaaaaggagttgaaccaaatggtcttcagggttgtgtctgactctggttaatgctattttggttaagagcaccactagtatgtggtgtgaactttaatctaccttttattcccctgtgccttattcttttgcagtattcatgaaataaactttctcttctggatcttagttctttaatcttttctctaaaagatttttctttgttccagcattttcttctgtcctgcatttattagtttgtatctcttcctgctgattaagcaaggattgccactgtttggctgctcagcttccactgacctcactggggaaaattacatgcagttaaatgtgaattattcttcccccagcaaagaatttctttaaaaaaaataaaaggaaaaaagacaacataaaaacccggctgctgccagtagtctgtcctgttatacaaagaacagaaagagaaaacctccctttaaaagtacttaaagatatcagacaacactgtggtcagctaatcagctcccgtttaatctaagaaaattggtatttccctatttttccctgtatttctttcaggaaagaaggtggtaaaaaggggcaaaaatgtggaacgagcccattaagtaactgtcacaaatgtaaaatgagaacagttatgatgatttaaggcatgtcaaagacttggccaagtataaaaacatatcttatttaccataacaaaaattcgtaaaattaaaaagaataataggaaattctcaactccagattgctgctggggaaattagctttaaaagtactaagtttgggccgggcacggtggctcacggctgtaatcccagcactttgagaggccgaggcaggtggatcatgaggtcaggagttcaagaccagcctggccaatatggtgaaaccccatctctactaaaaaaaaaataccaaaattagccaggcgtggtggtgcacgcctgtagtcccagctactcagtaggctgaggcaggagaacccctttaacgtgggaggcggaggttgcagtgagccaagatcatgccactgcactccagcgtgggcgacagagtgagactctgtctcgaacaaaagtactaactttgaagaatacatgaaagaaaatttttaatgaggaagacaaaagatgtaatatgacaataagtatcatgcttattcaggaaaagtaagaagctcaaggaagtgtttctatagattaaaaaattaatggtcagtaaagatggcttgaaagattttaggaaaaacattgtatgtaaaattcctgtgtccaaaaccctactggttcttattaaatatggagctttgttaatgtcatgaatgccagtgctatgaataaatgctatgttctactctgaaaatcccagaactatgagtggttctccaagactgggctaccattttattctaagtgcttgtttccccctggagttagatgggactaatgaggaagaatatgtgcttgttgggcaaaggagcacttctgcagacaaaggctggcatccccaaaagtataggctgatgaccactcttgactttgacaaagattgggcccattcctactctaataactcagacttaccaattgtcagataatggataaagatgaaattctgtgtaagaaaggtgacttaagagtggatagcatcagaaagtataagtttagtaaaaagttgagaatcatctgtgttttgatagtctcttttcctgaaaaaaaaatcacccaaagtcacccgtatttagaatgaagccatagtcttcttttccttttttttgctttataaaacttgattttgtttgggtgtttataaagaagaaacttgtaaagatgccagttttaaaatttgtgcccccccaacatggtaggaaaatatttacattttatgatgcatcctcatatttttttcagggtaaatgttcctaacccaacccttcagttgatgttttaacatgtttgttttactctttgcaatgaaaccaagaagaaaatttctctattctcaaacatgcattttaatctcccattcccacaaacttggaatatttatttaatacttgaggtattaatttaaaacttgaagcatatacttagtctcttattcctctccaccctggtctttgaaatggaaacataaaagtttattcaccataattttatacacagcttttcaggggaaaaaaaactgtactgggtaataagtatatgtagattgtttcagagttcttaaattattgaaacataccatttacatatgtaaaatgtactatactttaaagataggtactataattagtaaatagattactgttaaataactttttttaaaaaaaagtttcatctatgcacataggctctgagcagatttcagatagttcctgaataaaaatcaaaattgactatcagttgccattttatatatgttaacatataaagaaaaaagagtcatttgaggatggaagatcagctaaaaagcaagttgtaatatttataacagttctgcaggtggaggtggcagggattcattaagatcttgatcagagttgggaggaatagagaactcctgacactggatctcaaggttggaatcttcttggtttttcataaaatctactggtggcaggggcaagttaagtgagtcaagcggtggaaatgattgtattatctcagatttatgatctccacagtcttgattgagacagtccagagatggagggagactagtagaatcatttggaagaggagatacaattgtcattgtgggtttgtcagattggttactttcctgtccttccaaatccagaaggggaggtggtggaggcagatctgcatcatctgaagaagaaacagcagttccaactgttgaaccatcagcactatcttctgatgtaccatttacttgatcttttattttctctgttttggggttgttggagtcttcaatgttttcacttgattcaaacaacttaatttctaagtcatctgctaaaagtgtgcttttgcttggtttccagggtgtaagtgaaatgattgatgtacgttttgtggatatttcattttctctgatgttatccatacaaatgtcaggggtttctccatcagcaaatggagatctacctgcccaattttgatcatttaaaactggtttccttaagcatttccaaagtacaatgatgattatagctaccaacatagaagtcagaagtacaccaattagtatggcagctattgaattataattgtttttttgtggggtttgtttgttactggtagtatctaagataaatcctggtgtactcctaggtgaatttttgacagttgatgttggttgtgtggatggattatgaacagttatttgttttctagaagggatctggacagatgatgattgttgagtaaaagtatagacaaatgactttggtggttgtgtggtagaagtacgggcagatggtagttgtctggcagaggtgaacacggcttgctgggaggaggtgttggctattggtgttggttgtttggtgttgtaggcaagtggttgtccagcagaagtatgtgcttctggtttttcagaagaggtatagacagctggtgttggttgtccagcagtgactttggcaggtgatattgattgtccagaaaaagtgtcgctgaattgtgttggttgacccaaaggattccctgttgtgttttgagaattagccaatacctgtgacattgatgatgtgaataaggtaggctgtgactgcttctctgttgtaattgtctctgtctttgaaaaaaatgtattgttcaggtgtccacaaaacaaaattaagatgaaatatttgggatccatttcagaatatttcctcgttatctatagcgggtttataatgaaagagaaagacagttaggcgtcattggtgtctagttaaaaatttgacttttcattatgattcctggcataaagtaggtagacattattcctaattagtagtagttgattagtagttattattcctaatttagacttgatacactgtaggtttggtgtaacaactcttggatatactctaacccatcatacagcatttggacctcataagcagtgatctctcttcttttattaatacaagttctgtacttggctctgctgcccctctagcttcattatatttcagtacttcacttagtcatacttctcaaaacgcataggctctatatgctggatccatgtgttctctaccttttttcaccattttctactagaaatatattgattctcctgccttgaagaacaccagtgatcatctgttacctaatctaattgttctttatttcttctctcccctcccctccttgaccacattagacactactgttccttcactaatattcaagtagctttttgtaatcagtcttcctttcatgttactctcactagctctttttcttctgcctcctaaatatggttaattgatattctgtcctcacccttacctacttttctttgttcctgattctgtaagattttagttctcagctttatgccacaattcctaaacctgtacctccagcctacatcttctttgtcctaattctatttgtgtgacttcttggtggatttttccatattttatatatatagatagatagacatagatatagatataaatatctcccactatcagcaaattcaacatatttaaaatggagttcatctttaccctcacaactgacaactgactcttctcccaacttctctgtatctgttaatggtaccactaagtttcttaggcacagagtctattagtaatctttgaagcatccttagtgtctctgtagcgtggtagccttatgttaatattgcatatttttaaagaatttcattcaactcagagtcttaggcttaaaatcctagagtgatctctgaatctggtggagtaaattcaatccagttggtcaagtagtcctgctgctgctttcattcatctattggtaaatgccacatttgtgtggagctctgttctaggtttaggagattaaaaaaaaaaaaaaaagatagtcactgcctttaagtgtttcagattctagtgatagaagcaaacagtaaaggccaggcgtagtggctcattcctgtaatcccagcactttgggaagccaagatgggaggatcgtttgaggccaggagttcaagaacagcatggaccacatagtaagatcccatctctaaataaaaagaagaaagaaaaaaagctaaaaaataattacaataattttttttttttcaagacagtcttactctgtcacccaggctggagtgtagtggcacaatctgggctcactgcaaattccgcttcccaggttcaactgattctcctctctcagcctccaagtagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaaaactaattaagtttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaacattagggaatagaaaatcttagggtgttagatattggtatacatgattagaaactatagttcttctgactcataagcctatatttagagagatttgatgttctgttggaaggtgcaataaaggttttacaaattaccttttcagcatatctaaacagcatatcattgcttactcctctaccacttggtacacagtgatgataaatggccctgttttagtagaagaaaagatatgtgatttttttccctatacgaataattcaagcctgaattttaaaacagttctcctttgaactctcctgcacactgctgaattaatcttaaaagtgtgcatgatcaggttactactgccttgcttgagggtttaatttctgttaagataaaacttcctttttctttttttttttggagacagagtcgttctgtcacccaggctggagtgcagtggcatgatcttgtctcgctgcaacctctacatcctgggttcaagcgattcttgtgcctcatcctcccgagtagctgggactacagtaggcatacactaccacacctggctaatttttgtatttttagtagagacagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttcttttttttttatttttcttccagacctagcctcttcccctttctggctgcatatctgaatctgtcctcatctttcagacctcagtttaaattccccttcttaacccaagttctctgtgactgactacagcccaaacagatcagtcatttactgaattccccctagctctcatttattgtttttatggttccttacataattcatgtatgtatctcactcacacttctattctcttaagtaattgtgtttacttttcacattttcctatacctacttccttgaacaagattataaagaaccttgaagaaggcagaaaggagaaagaaaaatacttatctagagcatattatgtgttgtactatcccagttttgcatactttatttcacagaaccttcaaatgactttataaggaaggtaaagggatcccttatttacagataaagagacagtgtcaaatgagttaagcagtttgcctgatgttataccactcgaagtgacagattgggagtttgtacccagggccacctgattccaaagcatacattctttctgctaccctttattgcctcatgtttttatattttgatttctttgtagttaatgccttatatattaggagcacagtaaacatttaacctgtattgggcttcttgattcctttccattttagtttttgctttttactagtacttctaccagaaaataagcagaggcagtgaaatctgagttaataaattctgctttttatccattttgcaaaagatttaaaagggaaaatttgaacacttttggcatagatatagggatttgaataatctctggatggtcatcatccatgcagttcctacccattattcttatagattacaaaaaaaggcggggggacttctttagaaaatgttattctcttcagaacttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgataggctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcgaacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttcatttcaggctctcctgtctgctgtgagtatccttaccatcctctccctttttttttccctgacactatccagaagcatacctagcaattattccaaagaacccatgtacccgtgtacgttttatatagagttttccagaaatcccttagtctgctgctcaagcaaatttgtcagccctcatatgccggtttttactcattattataggctggcactttgaggtttaaatctgtgattttggttctttttctttgctgaatatttagaatattttaaaaagaaaaacataaatttaaacattttaaagacagttacagtgaagcaggagtccccgtgtataagacatgttctttttttttttttttttccgtttggagacagggtctcactctgtcacccgggttgcagtgcagtggtgcaatctcagctcactgcagcctctgcctcctgggctcaagcgatcctcctcacacctcagcttccctaaagaagttagaaactgcaggtgcactacaccacgcccaactaatttttgtattttttgtagacatggggtttcaccatgtcacccagacttgccttgaactcctggactcaagtgacccacccaccttggcctcccaaagtgctggaattataggcatgagccaccgagcccggccatagacatgttcttataaatataatgcataagtacttaaagggtccagcatttaaaattgatgctgttaagttggatatgttaggaagtatgccattatcttttaaagagaatcaagatttggagagcatatcctagacaaaagacaagtatagatagctgtatcaattactttgatataataaaagttgtgatgcaaatataatagattaaaatttagcagtagtattatctctaactagtgaagttttgaaaccgtaaaagaaaaaaccagccattctgcatcttgaggaaaagtggaaagagaaattgaccttcaactacaataggaagtatttgatgaccatcttgtatcatgatagtgaccatttactgagcacccaccaaaggctaagcagtatcctattttaattagctaggtggtggttttttcatcctacagataaggaaactgagacaccacgatgttgggtaacttggcagtatcacagctctaagtagtggcactaatacaaaaatcatgctaatcttgtgccagaaccgtttctttctatcacatttcactgtatgtgctatactgcctttcatagaaaagttatgaaatagaaatgctttatgaaggaaggagatgtgagttggtgggaattacacgtaaataacacttgtaggtagtcttagataaagggtaggaaagaaatacctgaaaacccattttagtcctgattctacgaaaactattataagaatttggaatggtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttcctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggatcgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttatttgcccattttacccacagcaagcatcttttatgcatattaacaattttctattgtttattctataggtttcttctatcttatactatgttctaaagtctcagataatgtgacataaacacgtagatgatattaatatacgcatgcatgtttgattattgactaacatttttggcttagtaagcttttaaaatgagccataatgttttcatgtcatcattattaaatataaaatctatatgtaaaaaataaagcatgtataataataatagtcaaataccacatctgatttctttttctttctaaattaagtgaaagtgaccattcttactatgcaaactaaaggggatacaaaaattttaatttatgcattatattatgtacaggaaaattctataaaaagtacattagaacttttaacaattaatattttggaggttataaattcagtcatagcctgtggaatctagttctatttctaacccttagctttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcgtgccactgcactccagcctgggagacagagcaagactctatctcaaaaaaaaaaaaaaatatgtgtgtgtgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaattttcttacctcagctgttaacttcttttgcagaatgctaaattcttgttctaactggacattttggtgatttggctaagaaaggaaaatgggtggttcaattcagatttaaaatgttcctctagcaaactgaaatagtttctgtagaaaaagaggaagtttatcaatagctggttccggaagtgcaataaaccacaaagtgactaagaaatatattactttaacagaacttattttgaaatacattttggagccctatgatttgagtgcttttaattatgtaaataaatatttgagatactctagtaatatgattatgtaaattaaatatttaggatggagtcccgaagagaaaattacatgttctaagaagaaaagctgccagttgggttatcacttacagtgagatttcttctcataagaagtgagtgatgtgttctgtttacttgtatgaccttaggcaagactctgcacttctgagtcaccgtttcctcctctaaaggaatattttattgggttattgtgaggattaaataagatagcataatataacatgtataaatgcctcaccaactgcaggtaaccaataaatgtaatgttatttcctcataatataaaaagtccagggtaaaagtataattacattattttgcaaatgacaggatctcattcttttttatggctgaataatactccattgtgtatatgtaccatattttctttatccattcatctgtttatagacacttaggttgcttccaaatcttggctgttgtgaatagtgttacaacaaaagtgggagtgcagatgtctctttgtacagttttcctttctgttgggtatatacctagcagtgggattgctggatcatatgatagctctatttttagttttttgaggaaccaccaaactgttctccatagtggttttactgatttacattcccactaacagcgtacgagagttccattttctccacacccttcccagcacttgttattgcctgtcttttgagtataagccattttaactggggtgagatgaggtatcattgtagttttgatttgcatttctctcatcagtggtgctgagtaccctttcgtatgcctgtttgccatttgtatatttgtaattaaattattttgaccaaatattttactagtgacttttgagttcaagttctcaactatttatttgattacccacaaagtagttacttctcagtggaaaataaaataaattggggatcattttttaaataagaagttaactaaagttaacttgttactaaagggtaatgaggggttggggagatggtgttaccagttaataggtacaaaaaacaatagaaagaatgaataagacctatttgatagcacaacagagtgactgtcattaataccataattatacattttaaaataactaaaagtgtaattggatcctttgtaacacaaaggataagtgcttgaagggatggataccccattctccatgatgtgattatttcacgttgcgtgactgtatcaaaacatctcattaccctttaaatatatacacctactatgtacccacaaaaatttaaaatacaaaaaatttttaagttaactaaacaaagtgtattgaaaggagtgagtccatctgaataaaaatttctttgagtaagtcacctttcctctcttgaaaaatggagatcataattcctaatttataagcttattgtggaattaaataaatgtaaagtgccttggatgatgcatattatagtaggtacggaatgtgttaacccatgcactgctttttcctggtcactgcgggaaacacaggttattatgaccttgttcttaacttcagggtacttatagcttggtgcaaaaagaatagtttttttttatgggctcctactataaagcataatataatcaaatgctataaagcttttgattcactggtttttggaagtattgttgtttttacggacagggtattgctgtgttgcgcaggctggtcttgaactcctgacctcaagcaatcctcctgcctcagcctctcgagtagctaggactacaggcacatgctactatgctcgctggctggcttatttatttattgtaaagatgaggctcttactttgttgtgcaggctggcctcaaactcctggcctcaggtgatcctcccaggattataggtgtaagccactgtgcctaacctgattcactatttttaaatccctgaattaagctggtgaactgtaatacccaggggtagggaatgtgtttttgttcaaaactaaatgacttttaaattttgaactcaaagatatcttacctaccattttaaaatacctgtcatttggaaaggaaacacttctgtttgttcagtaactatcattggatagtaccattctgagagtatatgtttaatagccaagatagtgagtggtgaattttaaatattcttttaaatatccttgtggtagaagctctctggtgagaaaatgtttgaccagtatgttgaatatgaaagtaatttcctatttttatgatgatattaatttcttttaattttctctgacacgtgtttatttatgacccttgattcaaggagtgctttgtgttactcctggatgtactggtgcacaatctcaaattttcaatttttgcacagaatgggaagtctgcccagtttcatttctaatctgggttatttttcccctcaaaagataacctgatttcagtcaccatgactggcatgaatattctcatgctttcctttttactttgttaacacttaactttatctggaataatattgttatgatttctcgtttagagaatagatttgttttttacaaattgctaataaattgataataaaaatgatgctttatttttttcctctcattttaataatagctagacgtttgaatttgatgaccaagagcagttatcaccttgagagttacgtaaaaattaccaatgcttagagttcaccccattccagttgcatcagaaggaagacatgggaattaggcattggtgttttttaaaaactcttcaggtgattctgacatgcagccagggtaagaatcactagcttagaagggagagtaagattgtagtcatacttgggaaaaaacatataaaaaatatttttaaaatggttactatattgcccgaaataaatgcccagtaagggatgagatttttgaaatgtggcctgatcttagccctgtgttaatttcagtagatatttggaaagtctctcaaaccaatttttgtaatatatttaattgaagatgggggggttctcaacttaaatgtaagtcattattttacttgaagccagtttctttaaaggttaaattataacctgaagtatgcagttttccagatttgaacacacacacacacacacacacacacacacacacacccctaataaatcattaggctacttggcatccttgaagtccaaaaattaatcaacctttggtacttgttgttaatgttccagtaagtagtatttatagaaaagatgaatattattaatcataaacagtgaaacatactttgcgtttacacttagcctattggtgtggctataaatcttatttattttagttgtgctctatttcttattgatctttacaatgtgttctctaaagtaataaagtgaatgcaaatatacgtggtcacaggtttattctgagttttaatttattatacaaaagtaaaggttttaatttaatattaatagtagaaaaacactttcttacgtgtgccatatggaaagataaaggatctattctaaaattagctgtgttggttgataagctggtgtggattctgccacatccagcaaggaagataccattaaattacacagtttagctctctctatctatgcattaggaatttgacttccatttgatgttaaagcatatacttggctttaaggacacactaaaactattcaaagtttaattacattcagacaaagatcatctaaccactgttgctacatagggaatatttatttaattatcccttgctatctctattaatcagtttcctcaatttatccttaaaattttcctcaaatgcttagttattttattatttgctttttaaaatattcagtgtcaaaacaaaagtacacagtttaaataattaagcaggcatacttctccctgtctcacctgcttgattctaaattgcaaggtctaccatgtcaaattttagataatcagaacaacactttgggattaaataccaactgacttcatttttactccataagccttctcattgctactttgcatttttcttcactaacctatctgtttgttagtaagtttttcagttccttcttcatcttttctttcccttgtagctgtgagcactccagtagattgcatcactaggttgggtcctgtgagctgttttgttcttttccaagtgtctgattcagcgggccatagaccgcttgccagaaaatcgccattgcttctaggctgacgcttgcctacttgttttgatcgtctgagagaagagactttgtttgccaaaaccacagttgatagaaatagaaaggtacagataagaaaaagcactgcaattataattaagcaaattagcatagccatgttgttgttgttttccgcacagacatcctttttgaaaatttcaccatgacttttgcttgtgttttcaatgctctgtactgttgaaggactgttgctgacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagcccacagacgggtatagtttgcttttgttccaggagacaaagaaaaaactgttgtcatcagaaaggcaagatgtaggtaatgtcctgtgtgttccatgtccgtgggcatgcttggcaatctgttgggatagcaatataatttgttagtttgtgaaagaataatggatcctagttttggtaattgtagttaaaagatagtgttgagatgttacaagtaaactacaagcttatgcctaatattcgctaccctgaattccttctcaactaaatttcttttctattcagctatgtatgaagaagcattttaatttctattaacacttttagatgctagaagttagcattacaaataaatattaatcattttaagtggactatcatggctttatatagttttcttcctttgaagcgtgctagacttctgctttgagtcagttagttctgcttttacttttctgattccttctttaaaaaaaaaaaaaaattaaggatcattcttacagaaactacccaccctctaacctgtcaccaatctttacagaagaaatgtggccttgagcttcttgcttcatgtatgaaataaatgcaaatttttttggtggaaagaggggaagtttggtagcaaccaaaagaaactgaacttcaaatagaaattcaaggtgttctttttttttcttgggtgttcatcttgaagcttagaataaagctggtacttagaaatacatttgtaagtgtatttgtgaacgcaattttactgtggtggttgtctcttttcatttatatttccctggactgactgtgtctttctgaaggcaaaggcataccagttttctcaacctaaaaatctgaagaaaaaaaaaaaaaaacagcaaatttcctctgagtagacttaaaagttcaacaaaagttgctgggttttcttttaaagcatcatttatacctagcattttttctgattttgacataattgtaaaaaaaaatgtgtaataaaatagaaatagagcatcaggatcttgatgatttgggatgaagtggcaggttataagcatctcaacagataattgaaaatgttgaatttccgctttggccctgagcttgctggaaactagtacaaaaaggagacaagttatattatacattttttaaatctaccaaatgattgatttaaatagaaatggcatatcttagaatttaacagttccatgtactgctaacccagcaggaaagatttataatcattattaaggtatcttataataatataccagtttgtcttgagctacttttgaaaggagtattttattgttagcatttatttgaatgaactaaaagcaaaactatattgttctcctgagatttactaaatgaaattgcctggttaagaaccctacgtatgctatagaaattcttctcaaatgtacttaggagtccttttatttaaaaaaaaaaaaaaaaggcagattcttacctagctagtataggtagggcctgaaagtctttgtttccaaaccaactcctaagcaacatggatgccactgctagtcaggcttttgaacatcaaggttttataagaaatggttgttatatgtcattggctgacatttgtatactattaaaatacagaaattgaaaataagaaatgtgatacgttgagttatgcaaacaaaagtagcatgtaataaacaatgctaactggagactatatttcatattaatagtagggaggaaaaactattaaatattccaggattaagattactttttagattatgacctttagtagacaattaaaggcccaagtcactggcttttgtataatagtgttcagctttaatttttaagtttagtgacataaatctttggatatttcatgattcttccacaaaaagaaatacttgaaattggattagcaagtaatttccatctttttatactagactggacttctgtattagatgctagaatgatttaaagtagattattcttttcacattagttcattaacagtgtagtatacatcatagtattggtacacattttaacagtgcttaccacggaacagataataggcctgctgttgattgtcttcagccagatgtactgcagtgcccaaataaacaaactgtatgacaaaatgagactttctcttgcccttacaaatgcctgagaattgaggactgtttttactccagtttatgccttggaggccaggttgtgttatcagaagttttcttatatctgatcattttcagtagaatttattttcagtagaatttgtaatgtccaagcattagtaatgagaaatttattttttaacttttgaaaaataacaaaacatttccagtttacttgaggaaaccaaacttagatccttcgtaatcctaatttaaaactccatggcgatggcaaattttttcatttctaacttaaaatttatgtaacaggacagaaaaaaaaagtatacattttcagtcacaattctagtttgttagtgagattcttacacactttgatagcatttcctcgaacactaatctgtcagacgttagaagtgaaaaggcataagaaaagccgtatatatatgacctaccttacaaaatgcttggtcaaaatctgattataacgtgattttgataaaccacttcttttcttgtcttctttttaaagcagaatagacttggagaatatgagccttaaagtaaatctgcagtaaaaaaggatatgtgcagctagttttccacttttaaaaccaaaccacagatgacacatttcctttccactgcaactaaagcacatgtcacaggagggaaaaaaaaaaaaacaacgaaaaagctccaacttctctagttggccactggcatgacaggaggctttgtagaaccaatccccgcctccagagcagggagggttttccacttaatgccttttgacagtatgctcattctataggcctgctacatgctttagtgtcattcaaaagaggttttgaaatggtatcttccatttcaaatcttctctaaaagacttatttgaaatctacagactgatttgaaaatgtgagtttggagtccatgggatactgatcagataatgtaacaattgtggaactgcagcaattatttgagaaaatatctagtaaacttagattatatgggacagaaaatgctttcgtgtggtgtagtgtgtgtatacacacacacacacacacacacacacacacacacaactgtcaaacatcctgtcatcacctcaagtttaacatgactgaaacagactttaagaactaggtatgggctgaacacggtggctcacacctgtaatcccagcacgttgggagggttgacgcaggcagatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtaagactctgtctcaaaaaaaaaaaaaaaaaaaaaaaaaaaaaaaaaaagaactggatatggcagcacatatctgtaatcccagctactaggtaggttgaggtaggaggatcactggtggagcccaggagttcaaatccagcctgggtaacatagcaagactccatctcttaaaaattaattaaattaatgaaataaaaagaactttattttttctttaaaggaggctgcctgtgacagtcttcttgtttctgttcatgatagcaacattctaatatcagaggcttagtatacaacacatcattttaatttaagtcctctcagtcctgatcagactttgaatcatgttggtccttccttcatattgttggatcagtttctttttccctgtttttactgtcaacagtactattttagatccttatcaggtcatacctagactctacagtgccttttcggtagccctgaatccttcttatatcttgtatacatcactgtctttggtcataccaccctttctttaagggaaaataaaaccggttgaacagttccctaatacatacaacaatgattcagaaatgtttgtgtacataaacatcagatgagaagattgtttaaaaattataaaagcaggacatggtggctcacacctgtaatctcagcactttgggaggctgaggcgggaggattacttgagccacagaaattcgagaccagcctgggcagcatggcaaaatcctgtctctacaaaaaatacaaaaaaacaaaaacaaaaaactagccgggcatggtggcgcttatctgtagtcccagctactcaggaggctgaggtgggaggatcacctgagcctggggaggtcaaggctacagtgagctgtgaccgtgccactgcagtccagcctgagttaagggaaaaaaaaaaaagataaaaatttccaggccccactacatagatccatatttagtaggtccaggttgggaccaggaaactgcatttttatcaagcaccacagttgattctgacgccagtagtccacagaacatatgctgagaaatggtgagcccctagtagaaaacctaagccctttggttgggcagttatggtctctccacaatttgactattctgtattttcccagctttatctctcaaaacttctctacctgaatcctccattctggctagactagctgtctcttcaacacatctagttacctgtttcttttcctttttgcctttctccataaggcctgcccagtcctcttgctgagtctgcattcctccttacctgattcagccactgtatcttctatgtagctttcactgactgcccagtttgtgttaatctctctctctctctcctttgtcttaataacagtattttctctgcatttcctttgataagtgattactttctacctcatatcttctatcttgaaatatttgtgttgttttaaaatcatttgacttgtcatatttttatcttattttctcccaacaagattaaaaattctgaggtgaagttttttattgatacatgataatttgtacatattaatggagtatgtgtgatttttttggttttttttgtttttgtttttgttggaatctcgctctatcgcccaggctggagtgcagtggcacaatctcagctcactgcaaactcccctcccaggttcaagcaattctcctgcctcagcctcccaagtagctggggctacaggcacgtgccaccacgcccagctaatttttgtatttttagtagagacagggtttcaccctgttggccaggctagtcttgacctcctgacctcaggtgatctgcccgtcttggcctcccaaagtgctgggattgcaggcgtgagccaccatgccctgcctgtatgtgtgatattttgatacatgcatataatgtgtaatgattaaatcagggtgattaggatatccattgcctcaaagaaaagaaattgtttcgtctagctgttttgaaatatacaatgttattattaactagtcaccttactatgaatagtagaacttgttccttctatctaattctaacaatacatatattatttattttattattatttttttaagacagtctcactgttgcccaggctgaagtgcagtggtacaatctcagctcgctgcagcctctgcctcccaggtccaagtgattctcgtgcctcagcctcccaagtagctgggattacagacatgtaccaccatgcctggctgatttttgtatttttagtagagacagcgttttgccatgttggccaggctggtctcgaactcctggccttatgtaacccacctgcctcagcctcccagagtgctgggaatacaggcgtgagccactgtgcccagccctgattatatttttatatccattaaccaacctctgaggtaaagatttattttaacttacttagtagtattatcaccagaatcatcacatatggaaaactttgggcctaagttaacatagattgttttgatttgaaactttggtaccattacttcagggctttttcatggtcctcactgtggctgctcccatttattagtattcttttggttttaagcaacatatgacctaatatggcttaatcaaaaaatggtatttattggcttatgtaactgagcagtcctgggataaatttgaccccaggagaggctttatctcatacacaaatgatatggccagggttccagtttgtctatttctcagctccttctcttcagtcttttgggaggctcttcttttatatcccaaaatatgagctagcaactcctagggctacgtattcccttgtttataaacaccaggaaagaaatatctcaaatcccaacaatttaagctaaactacctgaactgggcctctttggccctggttgtcctggtttgaataatgtgttcattgctgaatcagtctgtgatcaaggtgggataaatggattggctaaaaccatctcactccagagctccagatgggtcattcctaccagactattcgcctaaggagtttggtgggccctgcaggcaaccaactaattcccactgttttcttcctttcttgactcatgggcaaattttttattgttgtcgtggctcaaaatttttgaattggagatttgtctcttctcttagccttatttctcagtgtccaaaaaacaactgatttaaaaaatgaatccagactttgaagaattgttttatattattctctctagaaaatgaatcataaaataaaattgattagtggcatctgtatatttattttaaacactgctaataatctttgtcttttttgtcattttccttaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagtaagttccagtctgtgttttgtaaacgattcattgcttttcttgactaactagactatatcctggcctccctaggtgtcctacccctatagtggtgtataaaatgtcacgtaaggctgtcgcggtggctcacgcctgtaatccaagcactttgggatgtcaaggtgggcagatcacgtgaggtcaggagttcaagaccagcctggccaacacggtgaaaccccgtctctactaaaaatacaaacattagccgggtatggtggtgggcacctgtaatctcagctacttggaggctgaggcaggagaatcgcttgaacccgggaggtggaggttgcagtgagccgagattgcgccactgcactccagcctgggcaacagagggacgctctgtctcaaaaaataaaaggttatgtaaatctagatgtaggaagaccaacatttgtgtcatcatggaggtcctgtggaggatatgagacgtatacattttattctagcttaggctggaagtagaagagtgttttggagagggcaatttgttatgtcattcaaattgtaggaatgtgtggagagtagaaattacctaatgagagttctgattattacatgcttttttcagagtgaggaacatgaaccttcaggataaaatcagtacttttctataagattgtttgttttgttttgttttgttttttgatatggagtctcactctgttgcctaggctggagtgcagtggcgtgatctcagagtgcagtggcgtgatctcagagtgcagtggcatgatcttggctcactgcaacctctgcctcccaggttcaagcgattctgctgcctcagcctccccagtagctgggattataggcgcccaccgccacggcaggctagtttttgtaggtttagtagagacaaggttgttggccaggctgatcacgaactcctgacctcaagtgatctgcccacctcggcctcccaaagtgctgggattacagggatgagccactgcacccggccttctataagattcttgacctttttaaaaaggaaaattaaaaaatttttaaatgttttttgtttcttttgagaacatttatcataataattactgaaccatttgaatatacaatggtgggaactcttccttaaatggcatagtgttttgtttggttggttggtttctggagccttttagaattttatgtaaaagagtttaattcttctccacttcaccccgtcaccaccactttccaggttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtaggttttttaaaattctcttcagtttgatttggggtttgttgcttttaaaatgagaccatttaatgaattttaaaacagcctctaccttaatattgtaaattggaaggtatgcagtgttggttaaccactgtgacctcatcaagttgtggggtattcacatgaactgtggaattccaaacagggtgattcacactaaaccaatatatgtcctttctccatcatgtaaaacaacacgacatagcagatttttttttccaaagtatcctaaattaagtttttcttcctctaagtcctctaatttttttccattttcagaagtatatcactatttagtttaaaagtcaagtcagattattgctttacaaaagaaggcctaatgttcaataacttggtaacattattgcatactttccacctacatcactcttaacaaaattctcaaaataaatcttaagacaaataagtcatctgagcagagtgtaattggttccatttaggcttaataacttgaatatgcatgtggaaagagcatggctgtggagtgagtagatgtggtttgaacagatatgccactttctagctatgtactttgagcaagatactgaagttttcagatatctagtttccttatttgtgaaataaaggtaattgcctttcttatatacccacaaaagcttaaaaaatagtatgtgtagtagtatagtatagcaaactagcaaatagtttatacttagtaagtagtattttcttatcttttccctccctgccagcatctccttgcaccctttctcccttttctcccctctccttaccaagttaggataattctttgtctcaagtaccctgagactttgaagatttttcagatgtaaattcttaacttctgaaaattttccctgaggataacatagcccaggttttatagtgggccttttaggattccaaattctcctttacttaaagggaaaaagaagaaaatcaagatatgtttacttggatgggcttcagaaattgtacataagattttgtgtatgctttgcttcctttatctcataggtgtctgtgacacctgtcctgggttgaggaagtccaattctttataagtgttgaaatacacaggataaaagttttgtcaaaattgtataacttagaattcctgggaattagtaaaagatacaagctgagcactggcactgtagtcccagctactcgggaggctgaggcgggaggacagcttgagctcaggagttcaaggctgcagtgtgctataatcatgtctgtgaatagccaatgcacaccagcctggggaacatagtgagactctgactaaaagttttttaaaaaagaaaaaagatatgtaaacagaaataataacactaattttcacattttaggaaaatggagctataagcctgcctttaatttctaattcaaagatcttcattgaaaaatacaaccttttaacaattattagcctgggtaaacctgtattcttctctagtgacctaaagcaatctctgacagcttctgctttttgctgaagcatgtcatcccagagaaaaagcctttaggcagacttaaattccagtggctttttttccctatatggttgttgcatcaatatagtagcatgataaacattcagaggtaaggaaaacctgacagttactgaacaaactatttcctttactggacaggggagaaaattaaaatttttaaattgagtctgagtcttttaggctgtctcctaaattgcttaaatatattttcagacatttgtaagtgatgtttggtctcaatgaaacctggatattatagtttttttccatattggtggttatatatgatgtaatgaggtcatagagggaaaaatgggaggacttaattataagttaattttgtttttaaccttcagtttgtagggtaacttttaggacacccagaaagaagttcagcagatcctgattaaagattttcacattctaatttgatgaagggaagggccatctgatatctgtccctatgatccccattataactggatctagtgggaaagagaaccagaatttgagttttggctttgctaaaaatgtatggtgtgccttattctgacttaatttctattgatccacattaggaccataagtcctctcatattttatgtctcagtgagatgtattttaggaaagcctataccccgcccctctgtcataggagcctcacagtgctcttatggttatatcaagtgtgtccctttttataaaatccctaaatgattaaggggtattttggttttactgtagaattataacatcttatttctaactgatcataaaatttaaaaatagttgatcatactttgtaacagaatcacaaattgtatgttatgaaaaaattttggaactataaggaaaaatacgttttaaaacaacttcatttgtgttttctcctaggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtaagtaatgataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggactataaccctaacaaaaaaatgtgtaggactgacaaaacaagaaaagtataaactttattcataaatattaatatgagagaagatttgagtgaatgtaaaggcatattgtgttcctgcatgaacagttcttcccagattattacaaatttaatgtaatttcatcaaaataaccatgggatttgaggattgagaatggagatagaacttaaatgattctaaattctacataaaagtgcaataatagctaagaaaatattgaaaggaaagagacttgagacttaatagtacagatgtctgaacactttatagcagtacaataattaaaacatacatgtgcaagaatcagccatcagatcagtttaagagaaacagattgataaagaagcatcacaaactgatgagggagagattaaatcatttaataaatgaggctgggaaatgacttaaattaggtcttcgtcttcaccgtacaccataagataccaagtatgttctgcctgtatttaagagttgagtagggctgtgtgtggtggctctcgcctgtaatcccagcactttgggaggttgaggcaagaggattgtggcaggaggattgcttgagccccagaggtcagggctatagtgagctatcatcgtaccactgcactccagcctggatgatagagtgagacccttctctattaaaaaaaaaaaaaaaaaaaaaaaaaaaaaaaaaaagttgtatataaaagcttggaaccattttaaaaagaagaggaacaagtgaatatttaattgctttctagatgagtaaggacatatgaagtaaaaaagtgataggatgaaacaaaggaaatagcgaacagatttgactacataaaacttcaaaacatagctactcaaaaataaacacaagtgaagataattaaaaactaggaaatacacttggagcaaatatgagaaatgattaatatccttaatcggccagacgcggtggctcacgcctgtaatcccagcactttgggaggctgaggtgggtggatcacaaggtaaggagttcgagaccagcctggccaatatggtgaaatcccctctctactaaaaatacaaaaattagccgggctcggtggtacatgcctgtagtcccagctactcaggaggctgaggcaggagaattgcttgaacccaggaggcagaggttgcagtgagccgagatcactccactgcactccagcctgggcaacagagggagactctgtctcaaaataaataaatgaatgaataaatgaatgaatgaatgaataaaatccttaatcatgaagggtgctgaccgattaataaaaagtggattaacagtaacatacagatcatggttttttttttttttttattatactctaagttttagggtacatgtgcacattgtgcaggttagttacatatgtatacatgtgccatgctggtgcgctgcacccactactgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatgttttttaaaaaagaatatttgtacaaaaaaagaaaaaagccaggcaccatggcacatgcctgtaatcccacctgctcaggaggatcgctaagcccaggagtttgagaccagcctggacaacatagtgaggcccccatctcaaaaagaatatttatattttaagaaattcactaataaaagccaattgaaagaatagtgagataatcagttatcagcttggcaaagattttttttttaagatccattcctggtggtctgtggaattgtgagtagaggcaatttttctagaaaggcatttggaagtggataacaagaccttaagactattcataccttttggcctcataattctgctttttagcatttatcctaaagaattaatgttaaaatgtttattatagcattatttttatgtagatttttaaattgaggtatatcttgtcatcagtaaagtgcaagatcttaagtcaacagcttgatgaacttctacatgcaaatacatcatgaaagtatctccagatctagacatagaacatttctagcatccagagggatattctcagtaccctcccttcaccaagagtaaacactattatgacctctattgcacagatttattttgcctactttagaacttcatatgacattatttataatagcaaaaaaatgaacaggccaaaagtcaaagaataaggaactgattaaattattggttctccatctgatggaataatatgaagccattgaaaaatggctttgttacagaatttcagtttggaagatgaaaaggttctagagatggatggtggtgatggctgcacaatgatttgaatgtactcagtgccactgaactgtgcccttcaaaatgggtaaagccacggaactgtacatttaaaaatagttaaaatggtaaattttgtgttgtgtatattttaccacaattttaaaaactctttgagactttaggtaaagtgtatagataaatttttgtacaatttttgtcttataaatgtgaagctttttcaagtaagtttaaaagaagtttgcagaatttgtaatgttgaataaataatctcagtataggccaggggtggtggctcacgcctgtaatcccagcactttgggaggccgaggcgggcagatcacgaggtcaggagattgagaccatcctggctaacacagtgaaaccccgtctctactcaaaatatgaaaaaaaatttgccgggcgtggtggtgggcgcctgtagtcccagctactcgggaggctgaggcaggagaatggtgtgaacctgtgaacccgggaggcggaacttgcagtgagccgagatcgctcctctgcactccagcctgggcgacagaggagactccatctcaaaaaaaaaaaaaatgaataatctcagtataatcactgaaaaaaatattcagagcctactgcatgtatagcataatccccgtttttgcgggggagtgggagtgggttatacctgtgtacacacacataaatgtacattaactctacataaatttgaaagcctgaggagagatgagatgatacaccaatgttaatacagttttcattttgtggtgatgctttccttttaccaaactttctatgattaccacatttccttttataatgagaataaaacaactttttaacaagaaaggactaaaatggaggaaaataagacaaaacttttcaaaaattggcttactggcttttaaaattactttcttcaaggactgttctttcttcgcctctacaaaaatatatttgccaagtgtcttttctccaggcctgattctaggtaatagtctttaccttttaccattttttccccgaattctttatgttaaataattgttgatgtgattttcattgaccatcacatgctaatagtgtatttttttccaggtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcaggtattgagtttgctcaaatatttatctagtatctcctttgtgcacatatttatctggtgccacattgggcaaagcactgcgctagacactagggatagagttgtaaaaaacacagtttcctccttcagaaagcatgtagacactcacccagctcttcatctggttcaaaattgtaaatgtctagtgcatgtctcagagccagagaaaagctagttatttgcacagtctccttcaaggcataattatatatatatatatatatataattatgccttgaaggagactgtgcaaataactagattttatatatatattatatagaactgtagaaatctggtgacatttctagtgctttattctagttctctacattccaaaggtgtcagtagatgtttcttcttattgatgctatttgggacatctgctttcatttatagttctacataagaatgccaatattaaaataggatataatgtaaattttatttttatctgacaagaattaggcatatcatttcttcaaagtaatcatttaaggaaataatgccctcactcaaacactgctgctcctcctccaaataattagaaataaccttggagccagtgttgcagccctagaaaacatcctggtacttaatgtcatttcctatattttatttttttttgagactgagtctcgctctgtcacccaggctggagtgcagtggtacagtctcggctcattgcaacctctgcctcccaggctcaagtgacccttccacctcagcctcccaagtagctgggcctacaggtgcacaccaacacacctggctaatttttgtatttttttttttttttttttttagagatagggttttgccatgttgcccaggctggtcttgaactcctggcctcaagcaatccgcccgcctcagcctccccaagtgctgggattacaagcgtgagccactgcacccagctctgtattttcaaattactattttatattgatgctacattactgtcttagaaaagcatagagatactttgcaagtgactgaagatagtattgatagagatttaaaatttttgaataccaatctcttaatctctgaaggagtcaaatgaatatactcatcctttactggatattttataataaattgtatttactgacaggcctgtaaataaaatctagtatttttgaggcctcaggtaaaatagaattttcatattgattaggctgttccaatgaatattttttaattaaaaattaaattggtagagtgattaaaaacatgttattttccttcttcaactagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggtaatcacttttcttttgccttctgtactatagcatatctgttttatcatcaggaggttttttgttttgtaattacttttaaattaaactgaacttttttgtgctaaaactttgagtcccatgtttttttttttaaaaaaaaaaatcctgcttctttacaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtggtaagttctaggaaaggaatttgtgtttaccagttcctttctccattttacttcacctgatcaatatagattatcttatttatgtttgtgctctaacaccaagttgctaatttaagcctccagtaatgacatgaaatattaccaaaaagaaaataaattacttccattccatatcaagctatagtaaagattttctatgcatacttgtcatgtagagttatcccataagcggaatactcagtgccagttgaccatgttcagttaccagcactaatttgtagataaatgaagcaaggagcattaatacaatgtatctagaggtttgatttagggaacatgattatgtaatttttatatggtattcaaattttctaaattcaaaatgaaacatggaactttagaaattaaaaagtaatattttctgtctttacttgttcctttattctcttacagaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggtatagaagccaaaatgataagaaactaagttaaaatctttttttaaaaatatgttaatactatatagaagaaatattggtttattgtgctattttgtacttaatgcttaaataaaaacacttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgtctttgggtgtattagcaaacgagtgtctcatgggcagataaagcagataatccgtattcttagcaaggtacctgttccgccctcacttctcccaaatatttatggttctcaagttgtaaagcatatctttcatttttctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttcattaaggaagatgtctttaaaataaaatatgttgcctcttttgctaagcaggtacacttagtattttaccagttttcaaagcatttaattatatggtaagactatagccttgcataaaattatttaatttgtaattactataataatgtctgactcttataatgtagaaatgtcaaaaaataagaaaacaaatgtacattaagctagctaccaagatcaccatagcatgagaaatcattctagcatttattaaataagtaaatgttcctgaattcattccgagattcagtttaggagttaatgttttatttcaatgaaagtaaaataaaaaattctgttttcctaaaaggcacttgagagttgcttaaaaggacctgacacttacaacagtcaagttctgatagaagctacagtaatagcactaaccaaattacagccacttcttaataaggtaattactgtatagaaaatgagtgcattcattttgggtatcagtgttgaatgttactttctttcaaagagtttagaaaataagatgaattgagaataagttataaagaaaaaactatagttaaagtagaacctcttaaagtttagttgtttgaagtagtcatattagaagaagagtaagtatggatagtatgttctcaagcgcttgtaagtttttggtctcatcagtgctaaaggaaagataggtatatattcttaattattttatcttataactattaattatctgctattgccaagtactgttttaggcgctagagatagagtactaacaaagcccataaaactcactgccttcatggagcttactttctggggtgggtgtggaggttggggagtgaatggataatgaagtaaacaaaatacgtagtatgttagtgattattactatggagaaattaaagctgggagaagtatacttgatcgtcataagagtttgggtgccaaatgaagattatatttaaaaggagtaaaatgaagtggccactgttttaggatggtctgaccttatcccatttttatatttaagatatctggaaatcatgtttttgtattaataaaatgaaaaagattcgataatggcatggtattaccatccagttctaaagtggtttaattctgtgatttgagtacaaaggtatgccagacttgggagaaataacagagaaataatacctgttatattcctggtttgtctacaagcattctaattttgtattatacaaaatggttctctggtccccatcttctaagtgaaaatgagctcagaagggctaaataacttgcccaaagtcacatacctaataaaagaaccatgattctaatgtgatactatttgactctaaagtccatgtattttccctaatatcacagtgctaagtaaagattgccagtaataaatacttttaattcagagcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagcaaaaaaaaaaaaacaaaaaaaaaacagtactggcctaatactagtagaattacagaataaggataaataatacatgatcatccttacagaatgagcataaacaatacatggtaataatattaatagctaccatgccaggccgtatgctaaacactatacatttatttttaattttcataaccttaaggtaaaggttagcattctctgccccccatttcacacgtgaagaaataatctaaaagtaatcttagttttacttaataatgccacttaatgaaaaatacgtataattcatagtagataaggaagttggagagtctaaaggaaacttttgggtacttaattttactagtttttttattctgtctaatcttactttaaaatataccattagtggccaggagtggtggctcatacctgtagtcccagcactttgggaggccaagacaggtggatcagttgagctcaggagttagagaacagcctgggcaacttgcaaaaccccatctctacaaaaaaggcaaaaattagctaggcatggtggcatgcacctacaatcccagctactcgggaggtgaggtaggaggattgcttgagcctgggaggcagaggttgcagtgagctgagatcacgccactgcactccagcttgggcaacagagcaagaccctgtctccaaaaaaaagtgtgtatacatatattacatacacacatatatatgtaatgtatgtgtatatatatatataaagtgtgtgtgtgtgtgtgtgtgtgtgtacacacataaaatatgtaaaatccaactccaattaaggttaataaatgttaggaggggtgctaatggggtgtgtgtgtgtgtgtgcacgtgtgcatgtgtgtgtgtatatatatatgaacatgggcaaattacttcttagttcctttctaatttgtaaaatggagatctaattggggttggattttagttcatagagaatagaggagagaataaaatagtatgaaattacgtcccttttgtctttggataaaaatgggaagggtctaggagaaaagaggggaatgtttttaaaagaatgtgtatatacagtgagatttgcttgaagtgaaattaactgaactgtgggtacaaagaacaggattatggttttaagtgtaaaaagatacttggtctaaacattattagttcagtctaccagatgtagtgtgaacctggaacagatatgggtctgaaaaatatagaagcaaaattttagaggtaagaggtcttatggagtttattaatcagacctccattttgcaaattagaaaggaactaagaagttaagtaacttgcccatgcttgtacatctgttttgggactagaacccctctgtcctaattctcattgccgtttttctaaaactgttttgggacagtggtggtcagcgatatctagttgttggctatttatatgttaagaatatttgcaaattggccgggtgcaatggcgcatgtttgtaattccagcactctgggaggccgagttgggaggatcacttgaggttaggagttcgagaccagcctggccaacatggtgacaccctgtctctactaaaaatacaaaaattagccagggtggcacatgtttgtaactccagcgacctgggaggctgaggtgggaagatctcttgaacccaggaggttgcagtgagccaaggtggtgccactgcactccagcctgggcgacagagtaagactccatctcaaaaaaagaatatttgcaaatggagcattgcaaatggggcatctgcctcggtattttcatcttcaaaacagcccagtagcgggagctaatattgattctagtgccctttggatgctaggcatcagagttaataagcatgttaaaagtcaccgggatgtaaattgacagtcatttattttgtattgtaaataaaagtgatttcatcttccaccatcttcttatttatatgcttgactgtcttgcaccagttaatttgtagtagctaaaatgttctgtggttttctgcagtcaactgaaaataatttctctcaaattgaaaggattacttatcttgtcatactattgaacacaaaattaagtgagcctttaaagaaagctactgtgtgaacctcatcaaccatctcatgattatctttaatagagtccagaggaagtatttatggcaatccggaatcctctggagtggcactgcaagcaaatggatcattttgttggactcaatttcaactctaactttaactttgcattggttggacaccttttaaaaggtaaaaaagccttatttagaatatttttatgaagtactattaagaaaccagaagtaatttgaataagtgattacttgaaataaattgaagtaagttagcccttatgtcttactttaaatgcaaactaggccaggcgtggtggctcacgtctgtaataccaacattttgggaggctgaggcaggaggatcacttgaggctaggagtttgaggccagcctgggcaacatagtgagacttcatctctacagaaaatttaaaaattagccaggcatggtggcacgtgcttgtagtcccagctacttaggaggcatagatggaaggattgcttgagcctgggaagtcgaggctacagtgagccgtgatcacaccactgcactcagccctaggtaacagagtgagactttgtctcaaaaaataaataaataaatgcaaactatatctgtcttaatgagttgtgttttattcaatatgtgttttaagagagcttcatttccaattcaaatatcaaatttgcctgaaaaacaaaagagtttattctggctgggtatggtggctcacacctgtagtcccagcactctgggaggccaaagcagaaggatctcttgagcttaggagttcgagaccagcctgggcaatatggtgaaaccccctttctacaaaaaataaaaacattagccaggtgcggtggcacatgcctatagtgccagctacttgggatgctgaggaaggagaatcacttgagcccaggaggtcaaggctgcagtgggccatgatcgtgccactgcactccagcctgggtgacagagtgagaccctgcctttaaaaaaaaaaaaaaaaaagtgttgattcttacaaaaacctacatactgagtctgataatagctatattaatagtaacaatacctaagtatcttactgattttcaaaatgaaacagactgcaaatcactaagtgttatttgaataatttatattagaaaatgttaagagatttgatcacagattttcttcaacttgtttatagtttattgttgattaatactattattttataccattgtacatcacctttctggcaccctattctcacccctttctatattgcttatagccagtgatctccagctattcctcagagcccgctcattcacttcctaacctggttttactccccgttgctgacttcacagcttgttaactttggttcattaacatggggcagtcatggccagagactgcagttaataagaacagcatgtagtggtgggtcagaagcaaagcaggataaagtaagacctgggataaggagctggcatgaaccccagtggtctcagaagtggatttggccacaatagagattcaagctatagcttgagtcaacaattttgtattaatttaaatcataggcttgagggaccatggagattctcccagtttttatgagagagagagagatatgcatacacccactattgtgaatgtatgcatttgatttcactttcttatgaaatttctacaaaaaatattgacagtgttaatctctaaggtcaatggggatttctcaaaaaatactaccttactaaaggataccaagataagtaattgtaactgggctaataaagtgcttaattattctttatatctaaaagaataccaggctgggtgcagcggctcatgcctgtaatcccaacactttgggaggctgaggcaggtggattgcttgaggccaagagttcaagaccagcctggccaacatggtgaaacccctgcttgaaggcaggagttcaagaccagcctggccaacacggtgaaaccccatctctactaaaaatacaaaaattaggcaggtgaggtggtgcaaacctgtagtttcagccactcaggaggctgaggcacaagaatcgcttgaacctgggaggcagaggttgcagtgagccaagatcctaccactgcactccagcctttgtgacagagtgacactctgtcttaaaagacaagaaaagaaaagaagaccagatactttccatgttcaaatcacctatttttaaatgggggaaggattaatgattaaaagctggccaaagatcaaatttatcctctaatcaaccctatttattgggctcttagagcatatacttcctatgtcatcagcttttcttttaattaaaaatgtttttgtattccgcctgcgactcggtcccggcgctgggctgaggggaggggttgtcttaaaagtctctccttccccctgtaggggcggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaataggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccattagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcagtagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctagtcttgagtgactgtgtccacagttcatttttttccggtaggaataactccttttctacatccacactccatagagtctctccttttcagacatcctgggatgaaagaatttggcttttttttttttttttttttttacatctgttttcactcttaggcttttaaacaatagttattgctcttatccctctcagattctaataactgagagcgatggggctatattgaatctctgtatgcactgataactgagctatgaagaggatcttattaaactgctggtctgactctatggattgacactgttcctttcttttattgtgaaaaaaaaaacccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcgataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaggaaaattgcacaatttagagtagttatgccatagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaactgatattgtaaaaattaaagtaatcttgaaaatgttttgacaaaagtaaaattaaagggacatcttttcttaaaaaaaaaaatgtttttgtaaaagaaccctattttcaaatgaaatcttaaggagaattataatacatagatttttttttttaatctctgtgctgctttagggaatagaagatctgaaagactatcatgttttttaattttcctcttcctggagtactgtagagttctagggaatattatattctacacatttttggtacttaatcttatacataattaattattctcattcacatatgcatgttttaccttcccaaatggctattcttggaaagtaggagttatatttcctttccttgcagagttgttagtcagggaagaagacctcagcagatgcttgttcaaaaaattaattcttacttgtttgtttgtttgtttgtttgttttttgtagggtacaggcatccttcacctgctattgttgcaagaacagtcagaattttacatacactactaactctggttaacaaacacagaaattgtgacaaatttgaagtgaatacacagagcgtggcctacttagcaggtaaaaacacaaaataaacaaaattaatcttgctacatctatatataaggatcacccaaaaagtacaaatacctataggttttttggcggttgcgtggcagagcagaaagttcacagtctagtcctttagtggtggttacaattttgagagttttgccagaacatttttctgtaggaaaaaatttaattcccattaaaatctgaaatgtgttcccttggtcatctttggttcaagacactacagtggctctctgttatctgtcataaaatctgaatgcttcagtctagcaccctgggtccttaaatagccctctcagttctgttatctttctctaaatttcatgagcctcattttttattaccactccaaatggatgagctattttaagctaatctacttgccatctcctacaagcaactgcctcttcaatattcattccttatgtcattttatctggagtatctgccctatccccaccattccattaaagcttcctatttgctcttatctgatttttgtttctctactcagcaacacttagcacttatgtacaatacaattcttgaacatagttgtttgatagaaagtgctgattctcagtttcacagacttgtatttgttcaacttttttgtttgaaccgtatcatcttgagcaaatcatttaacatctcagtattttttctcattcagcttaataatacctgccctgcctactttgtgtttgttaaagatcaaatgtatattaaagaacttggaaaataaaagatgcttattaaatctctctgtatatttcacatttatgtagtcttccaaaatatgtgcacatttaacaggtactatgctctttaggagactgtaagaagttcatcctgttttaagtcacacttgtgatttgttaaattttttaacctgccaccgttttccttttagctttacttacagtgtctgaagaagttcgaagtcgctgcagcctaaaacatagaaagtcacttcttcttactgatatttcaatggaaaatgttcctatggatacatatcccattcatcatggtgacccttcctataggtaagtggatttactctcctataattacataatcataatcaagtttcaattttccaactaatggaggcaagcagcagagtaatctagaaggtaacatgggagaaatctagagatggcctaggaagagtaagtgaaactcattttataaatgtgtggtattttatgtgggttagtaggaaagttattcttccagtctgattgtgctaatgttaacattagtttgcctctgaagcacagaccaaatgaacaatgaaaagagatgctcttgaaaatattaggttgcaggggaagggcctggggaaaaaaactaacgcgaaatataaacaacacattacgtgcttggatagagaacgaatctatacagatttgtaaaaatacaggcatgctaacacatttgttgtatttactcatatcacacaagttatttaaaagttttctataatgtagacatagatggtaaaaattatatctgctatacatgggtttgggtagtatatttttcagtataatttagagaaatttcatgaaaatggcatcattgggggatttttctgtattttcaattaaataaaaatatctttaaggtttagggacagtgttgaacacagaaaagttatcttctgttcgcaaaactcgtatcattccatttatcaacatcctgctttttgataaaaagacttcaacaatttccttaagattctaacaatgtacgcaaaaatttttcaaacatggtattcaatagtcttactttcgtcagtcccattattatattactttgagatatgccctttttgttatagaaagggtaaaatagtttgcctgtgttcccctgtcaaagtataaattaatatctgattttcttggtttttaaacaattgcctatttagacttaattttttctgatttaaaaaaaatcagtgcaataagttcaaggtcttttatcaacataactacagttaatgtattttatacttgaaaatagctacgagtagattttaagtattctcaccacaaaagataaatatatgaggtaacacatatgttaatttgcttgatttagccattctacaatgtaaacattttatttatttttatttttctttattaattttttttgagacagagtcttgctctgtcgcccaggctggagtgcagtaacacaatctcggctcactacaacctccgcctcctgggttcaagcgattctcctgcctcatcctcccgagtagctgggattacaggcgcgtgccaccatgcccagctaatttttgtatttttgtagagatggggtttcaccatgttgggcaagctggtcttgaactcctgacctcaggtgatccgcctgcctcggcctcccaaagtgttgggattacaggcgtgagccacagcgcccagccaatgtaaacatattttaaaacatcatgttgtacaccaagcttgctcaacccatggcctgcaggccgcacgcagcccaggatggctttgaatgcagcccaacacaaatttgtaaactttcttaaaacattaagtgattttttggggtttttttttttttttaagctcatcaactgtagttagtgttagtgtattttatatgtggcccagtatattcttctaattccagtgtggcccaggaaagctaagagattggacacccctgttgctatacctttttatttgtcagcttttaaaaattgcagtacagatctttttgttcagcatttggtgagtacctactatgtgcaagatactatggcaagaaagttgataattcctagggatacaccaagagtttgtatcctaaagccctttaaagtgcaattttaaaattaattgattgctgttgttaggaaataggacagccacttggaaggagcaaacgatggttgtatttgtcaccatattaattgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttgaaatttcaggattatcaaaattttccatgtcagtgtagcaaagtttttgatgccatttaaaagagagtttgatagatcagttaagcattataagttgagatagagaaatgagaatgggaccttgaaacagttttttctgaatcttatactaaatattgtgactctccttattttgttttgcctttgctggccagcagggaatgggactctgagacatattagataaatacctataagaaaggaagagtcttgctgcactcaggggatttaatgatatactgtaatacttcccaaaattatcatctgagagaatatatgaatatggtatgaagctgtaatagtactatttgccgtgctttctttgaaaagacaaaaagacatgcttctcaattaccgaaagaaaataggattcttttttttcttttttcttttcttgatatgaagtcttgttctgttcacccaggctggagtgcagtggcgcaatctcagctcactgcaacctctgcctcccgggctcaagcaattctcctgcctcatcctccctagtagctgggtttacaggcacacgtcaccacatctggctaacttttgtatttttagtagagacagagtttcaccatgttggccaggctagtcttgaactcctgacctcaggtgatacaccctcctcggcctcccaaagtgctgagattacaggcatgagccaccatgcccggccggaagataggattcttgaaattaagattgctcagttacatcaacatttatagaatttttgtctctgagaagtacacctgaaatgctgcgagactcatttccattttagtaactgaaagtaaatgaatgaaaaaacccactaggccaggtgcagtggctcacgcccataatcccagcactttgagggactcaggtgggaggattgctcgagtccaggagttcaagaccagcctgggcaacatgacaaaacccatctctacaaaaaatacaaaacttagctgggcatggtgacgagcacctctagtcccagctacttgggaagatcacttgagcccaggaggtgggggtagcagtaagccaagattgcaccactgcactccagcctgggtgacagagtgggaccccgactccaaacaaacaaacaaacaaaaacactgatcttacatcgctcctcagaggaaatgcagagatgttcttgcattccattgggtaaaattgtaattgttactggaatacattaggatctgtatttcagtagccagcactgaatggttcaacagatttcagttatccatgcaaacatatttaagtatctttaggtattggaaaaatgtttgtgttcataaggaaattagtgaacaaacaacaaattgtaacataaataacgtgccagtaaaccgtgaaagaaatagaaaccatgaatgtgtcaatcacagttactagccacataggtgtgttactgttgtttgagttcccttctgttagtaccttgccataaataatcatttaggagtttcctggttactttgtgttttgtaattctggattttcatgccaatgaagttgtaaatgaaaaactaacctcagaaaaaaatatattgaattcattcaacccatgtactaagtgaaaaagataaggtaactgccctggaagactttgtaatttgtgtccaagacttataatcagccaatcacaacagcaactccaggtgccattaaaatgatatgtcttgatggagaaagctggagatctggggaaattagaagaaaaaaaactgcagagaggagataacatttgggctgtgtcataaagatttaatatatgcttgcaaaatagcaggataagtaggggcatatgtttaagagcagtggggaatagcaagaataaagaaaaggcaggaaagcaactgatgatacatcatggcatcatggggaatggggtaggaaatgagatgagaagaaggactagaactcgattggaaacgactgtatgccatggtaagatatttacccttatcacacattcagctgaggtatttaagtaggagaagaacatgaccaaattttaatttttgccaagtttttctagcagcaatgtggagagacaggaagagatttttagcaagggaaccatttaataaaattgatatagcagtccaagcaaaaaaaatggtgtgggccccgcactaatgcaggagcaatgggagaatggagaagaaccagcaggtttggagctgggcataatggtacacacctctagtcccaggaactcaggaggccaaggcaggaggattgtttgaggctgacctgggcagcatagtcagaccctgtctcaaaaaaaacaaaaatcaggtttggaataggtttctgaagtacaatggacatgacttagtgaccaattgttgcaggtggggaaggggagaagactgtgaaggatgtcagaagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaataaaataaaaaggacaagtgagaaaggaaggaaaactaaatgtagaaagtagtgtcccaatctcatgtactttggaaagcactgactggttttagaaaacctgagttttccatctggtcattgtctagatccctagccatgctacctcagactaattacttaactgctcatggcttcatcagtgtacatgtgcatgaaacgaagaagccggactagatccctttggactgttaaattatttggccttggtatttatgactattatgaatagttattcatattcttgaggtaatagactttgtatttctcaagtgttaaattgtcagattttattatattggctttaattctggctttaataaaataatactgttggccgggcatggtggctcatgcctgtaatcccagcactctggggagaccaaggcaggtggattgcttgagcccaggagttcgagaccagcctgggcaacatggagaaaccctgtctctactaaaaatagaaaaatcagctgggtgtggtagtgtgtgcctgtagtcccagctactggggaggctgatgtgggaggatcacctgagcccaggatgtggaggttgcagtgagctgaaatcatatcactgcactccagcctgggccacagagcgagaccctatcaaaagaaaaaaatagtgttaatacatgattacatgattagagaaactaaaagccaaatgggagataatgctacttgctatttttgaagcatctcccagtgtatctggtttttagtattttcaggcatgcatatctttttttcaaagcttaaaaaattaaaatcaaactctgctttcttcctaagcttggaaattactcatgtattaatgagtagttcttggcaccagcagcgtttcttaaactgaaaagactggtcagacatagttgacctttgctactgaataatgcctaccattgcatttattatcagttatcatatttgttgatttacctccagtgtagtttggtttacctccagtgtacagaatacaatctcagtttaatttgcaccagtaaggtgcaacctatcctgaaacagaaagctatgggaacaaaaccctttgagaagatggaaaataaaggaaagaaactgctccagggatgtattagagctttctttgagtcctcagtgaaagcttaaacactttatgtccaaacattttctttttagtgtattcccatttatagacactgtagttaatgaacttgcatattcttaacttttgtttataggaacaaggaaaagttttgatcacttgatatcagacacaaaggctcctaaaaggcaagaaatggaatcagggatcacaacaccccccaaaatgaggagagtagcagaaactgattatgaaatgggtgagaaacaaagtattgatctagatcattgaaaataaggtgggagagtacatgaaagtcatgtttattttccagccatttcttagaatctttagagtgaaatatagaaacgtttgccatttctcaaaagataaactctaccattcaagacagttatcttgaagcttgtgtaaaaattaatcatatatattatatacagcattgtaaataggtagccaaaacttttgtgtaggcgaatagtaattctctatgatgtttatgttagtattttaagtatctactaaagaaagctgttgaattttagaagtaacattgaaatagttaggtgaagtgattatccaggtgtttgatcacgttaattccctatcttgctgcagaaactcagaggatttcctcatcacaacagcacccacatttacgtaaagtttcagtgtctgaatcaaatgttctcttggatgaagaagtacttactgatccgaagatccaggcgctgcttcttactgttctagtaaggatttcccctttttgagtcccccaccctcaaatttttattccagtctacttttaggaggcccttaaatattaaaaacatgaataggatacagtcttctacttctcacccaaacagataacaattcagccacaaagtaaaaatgttgtgtgtttacttttttgcatcttggcaggctacactggtaaaatataccacagatgagtttgatcaacgaattctttatgaatacttagcagaggccagtgttgtgtttcccaaagtctttcctgttgtgtaagtatctccttttgattttaattcaccttcgtgcctgtctttaagttaaatgcttacccagtaatgtgcactggttgcaaagagggcaaaatgagatattgtgatagtgattttagctttgagacagtaggtttaatgagggttaagattagttttgacctactagatctattagaaagtttataaggaaagacttttaaaaaatctggttgatttatttaagtggtttattttgatgatcattgctcattttcctcacttagaagcaaactattagactgctatatctaaatcagcatatctgttttggtttactttttagtagagcttttgtatttatccacagctgagtgaaaacaaaattgaccttctgtttaggaggtgaattgtttactctctcttaaggactaaaaaatattaacctcaaagtgttcaaatttaaatagttcaaataaattcttttcctgatctaggccttctatatcatgtcattattttctttttttaatctcatgttagaattttagagagttagaactcagttatttttattaatggagtgtagccgggttagaaataatttttttcctaagtttcagttggatcatgtatttcactccctctaaactattttgctttccctatttgatctgactcagcattttaaaagcactgattaacattaaatttaatttttttctttttgttttgcacagatcctaaatttagttttaacttcctaagcgcatgtcagtatacaacagatggaaatagtactaaaacatgctaagtagcagacagagccaaccttgtcttaagcaaacatttaccgtatatggttacacatggttatatgacactaccagttgtttgttttcacaatttcttccctggtgactaaaaacaaaagacaaacaaaaacagacacacacacatgttcattgtagaaaatttggaaaatgaagaaatgccccagaaagtaaaaagcactcatctccctttaattttggcacattattctggggaatgtatattatgttttccactacatattttcatttaattttcctctaaaatgttcctctgttgactttttttttcttttaggcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagtaaataaatgtatctggagaaggatggttgatgaacttgctaacatgcgcgctgttgtagaatgcactgactacagaattctttataagggatagacttgttcatacttttatttccatattccatttttttactctctcaactgtatgtccaatgtaactggttgacaactttttatgctgagtatattttaagtaggttttagttgctttgacactcattctaaaaacatgttttcaacatgtacatagggtttatatatcatcagctatatgacttatttaatttctgttacaattaaaagataccttgcttgttataagagtaaaatttgatttgttgcaggttttggttttaatggcttgtggcggtttgcaggaccgttttcaaaggtaagaaaatatatttttctctaacttttggcaaaatgaaggtttctgttcaaattagtatgcctgctttaagaacacacaatgtgctgaaaaccagaaaaataattcacaataaacacatatgttacttttataaaaagtttctcatcacaaggtttttttccaggaggcagcatggtgttggggtgtgtgtattcacttttacaaacaaagtcaacttatgatcaatttttcagaagagtatgataaacctctgtgatacttttctgccacagtcccttgtgtatttgataatcttaatgcacacagttagatatcttatgactagcaaggagcattaccatggttaaaatctatttcatgaaaacatttttatttccagcctattagattagattaatttctctctggatttgtcctcatttgctcttattcagtttttttgtttgtttgtttgttttgtgagacggagtctcactctgtctccaggctggagtgcagtggcgcaatcttggctcactgcaacctctgcctcccaggttcaagcgattctcctgcctcagtctcccgagtagctgagactacaggcatgcagcaccacgcccagctaatttttgtatttttagtagaaacagggtttcaccatgttggccaggatggtcttgatctcttgacctcgtgatctgcccacctcggcctcccaaagtgctgggattacaggcatgagccaccgcacctggcctcagtttgttttttgattggcattagtttatgtagtgctacataagatgtatatgatcattttctctgtatgtgggctctctccaaattgatcaaagttccttgaagacagggtttctgtttcttccttaaacagttcctggtgcagtgttttagatacagggggtgctaaatcaatatgaattgtataaaccttgttccagtttttaagaattgggtattttatttatttcctttcactattacttgaatatctgtcaacatgcaaaggttgtcacttaaaaaatgggcctgaagttacagaaataagtatatcatacagaagtttttgcatttggattgccagtaaccctctgagccctttacagtgtctagtgagtggaatctaaatggcagctggaatgatgatgctctgctcattttctctgttttggaaaattggctagacatcattcctggtgattgtattgtctcagtattacattcagtctgtcttgtgcatggctttcagaaaatgcaggttcatctggaagctttaagctgaatagaactccctgttgtaagtcctatggtagtctataaatattactccactccccttttttaatgataagtaatacaaaggaagaaaaatagtaaattaagtccaaacaaaattaatatttttggcttcagatggggatttacttaaaaaaaaggaactaaaataatttcctattttccattacagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagtttgggcaggaagaggaacttaaaacacattattctgtaagtgaacagaactataatttatttactagatatactaacattgccctaagggcctctttctctgtctctgatacagcatactatatcaaaaaaaaaaaaaaaaaaaaaaaaaaagaagaagaagaagaaacacaaaatctattaggtacctcactttcctgctgccagcaataactcaaccatccatagaccatcctgaaaatctggaagtaaataaataatcaaacaaaaaattcatctcaagaaaataacatcttaaagcccataagcatatatataccaattcgtaatgcaacttagatttgaatacactgagaaatactaatagctaatagctccagtgggactgagataaacaaggtgggagaaatggcaaacctacagaactctggacttattcagtgtcatagtgaatggtttcatacaactctggttgaccctggaggtgctattcattatagaacttaaactattgtgtgtgttattatgacagtgagtaatgaaggaaagcttttgttatggttgtgttttctatttagaaagatattcttctaaaatggttaaaaataaaagaaactttagttgtttaacgttccattatctgaaaagttcacttatgaaacacatcattgtataaggaaaagttactatatatagttcttttaagtgttagcataaatttaaaaaaaatccaatgacataactattctgtgatattcaagatcaataaatagaattcccagtttatgatctcagttttgcatgaacatttcaacttatgtaattttgaaggttctgaagaatttggcaatacccaattcatattataaactattatgtaattaactatattctattaaattctgcttaacaacaaagctttggtcagcagaggaaacaaattttatttccacatttgtcagtcgccttacaagtaatccttttttcccccagaagtaagagaagtctaactttttttcccatgtaacaaggtttgtttgccctctgccactaactctctagtacagtgtttctccacgtgtgatcccagaccagcagcatcatttgggagcttgttagaaatgcagatgctgtagtttcacctcagatctgcacaaaaaactcccaagtagagcccagccagcagtcagtgtgttaataaataccccaggcgattcttacacacactagaattggagaagcactgccctggggtctgcttctggtcttgcccattatcagcatttcagctgtgaaggccagggcaaaacttaaaatttactttttttacagatactgcagccactgaattccttcctgcttccccgctgataaaccttttagcattttggagctagggaaccatacaggtaatttagttttaggctcacaatattgtgtacattggggagactgagttttagaagagctgggttaactgctttatacagttcttatctagaaccaaggccaggcccttttgtactacattcattgccttccatggctgttgtctgtttgattatctatctactttcccttctccttctttatttccttgtttttgtttgtttattgctaattcattacttctgtctgccttgccttaagcccaccagttcttttttttctgttggactattttctgggttactgaacagaagttgaaaagtttttaaaagtctgcttcatcttaaccaagcttttgccttttgggctactaaactggtgttaaacatgtcaaaaatggttagtttttttattgactttttttacccagtctaattgtagggaaatttctgcctatctttgcccactaatggagacaataaaataatctggatgagaataaagaaccattacaggtttctctgctatttgattagttgcatatgtccagtgttgattggctatttgccaaatcatttgctttggtgaaacagtcttactctacaaccttttacttaaaattgtttattaaaatcagaataggttttatggctttggttccagtttcaaactaatggtgtcacctccattagctctccaaagttggtgcctttattcaggctggaaatctctgactatacacagaagagatgaggaggtttaaaagtaatagagttaagtggtattgtggtgttcaactcttcctgtcactcaattgtgtgtcattggtttgacagtttattttactacatgttttcagagaaagggtttatcttttcaaaagtaaccttactctcccacaaaacccatttgtatctctaaattacaggctcatgttcacaaaaggatcccaatttatatgcccaatcactgagtttttgtcatttgctcttacagaataactcttaatggtaagagttgatcttttgtttataattaggtatattgcttcatatctttagctccatgtaatcttatatccttatctctctctttttttttttttttttttgagacagagtctcgctctgtcgccgaggctggagtcagtggtgcgatctcgactcactgcaacctctgcctcccaggttcatgccattcttctgcctcagcctcccgagtagctgggactacaggcgcccaccaccacacctggctaattttttgtatttttagtagagatggggttttatggtgttagccaggatgatctcgatctcctgacctcgtgatccacccacttcagcctcccaaagtgctgggattacaggcgtgagccactgcgcccagcattttttttttttttccccctttggagacagtgtctcgctcagtagcccaggctggagtgcagtggcgcagtcttggctcactgcaacctctgcctccttggttcaagctattcccctgcctcagcctccctagtagctggaattacaagtgcacaccaccacgcctggctaattattgtatttttagtagaaacccggtttccccatgttgaccaggctggtctcgaactcctgaccttaggtgatccacccatctcagcctcccaaagtgctgggattacaggcttgagccacggcgctcagccatctcatttctttatggcgttgagtttgcttatatcaaaaaaccaaaagaaagttgtccagattcctaactcagtctggcgtttcaactttgctgtttagctgtatagaaaccaaaacatttccttatctccattcccagcagccaagtctcaagcagtagtattgaaagaagttctctgtcattccccgatatggagcataagtttgatttaccatcaaattacccaacatcaacctatacttagtcaactgagatttaaacagataaaggttccattgccctatttcaaaaagcaaatgttgctgatctgcacgcattcaatcctttgctataaatgtttcatgtcaatgcaaaactcttcattctagatctttgatgtttagcaggatcagctactgagctgtattttcttttgtccaacattttctactagcaaatcaacaaaataagagattcatgaacctctcctcctccccctcctgccccagcattaggtcttacttaaattaaacatttgggcagtatttcgttagttaccagctttgaggagaagtggtagtcacttacataaagcaattgtctctgaaaatgcattcttcttgacaaattagcatagcctaattctccatcctaagggggactgttttacaagtctacatataaaagtacctaaatggttgtcttctgaatccctccctagtagaaattgaatttggcatcagtggagccagtgactgtacctgggattcagtgcatatagaattgcattgactgtgaccctttaggcaaatggatgtaagactttggctcttaggattttcccaaacaccaataagagcatcttgaagagaatccatttactttatgatatataaggatatttcaggtttgatattatgatccttattaggtccagtctagctgagctggacatgaattgaagaaccagaattagaactagaaaatgaaacccaggctgagtgcggtggctcacgcctgtaatcctaacacttttgggaggccgaggcaggtggattgcttgagaccagcctgggcaacatgacgaaatcccatctctacaaaaatagaaaaattagccaggcgtagtggcatgcatttgtagtcccagctacttgggaggctggggtgggagaatcacctgagccggagaggtcaaggctgtggtgagctgtgatcatgccactgcactccagtcagggattgagaacctatctcaaaaaaaaaaaaaaaaaaagaaggaaagaaagaaaatgaattaataggatccatttccaaagcattaaaatttaatatatactttatcagggtcttctgatattcttcagaggagaattgttgtaagttaattcaataaacatttgaatacctgttttgtaggtgtatgttaagtatgtattagaatccttgatcaccagagacttgacggtttttgccttgaaagttatttccttccgatccatgttgtttaacaaattctaagtgtgcactattttttttattttaaatacaagattaatactatagtgcactgtagaaaataccaaaattccagatatttatcctacatatatgtattgtttactatatgcaaggggctcttagaccccaggggagcagaggggctgccagggcatgatacctgccttcaatatatttcagatcagaacgggcagtagaatgtacatagataactattttgacctctattgtgatacctgtcatgttgtaccttgtactatatagtattctgatagttcaaagggacatttgtgtggaaggatcatgtaataattatggcaaaagttttataacacatttttcacctcaaaaatgtttttaaacaaaacaagtaaattcgtgatctatttaatttttttttttttttttttgagatggagtcttgctctgtcacccaggctggagtgcagtggcacgatctcagctcactgcaacctccgcctcccaggttcaagcaattctcctgcttcaccctgctgagtagctggcactacaggcacccactaccatgcctggctaatttttgtatttttagtggagacagggtttcaccatattggccatgctggtctcgaactcctgaccttgtgatcctcccacctccacctcccaaagtgctgggaattacaggcatgagccaccgcacctggcctaaaatttttttttactaggaaaaaggctttaacttttttttgtttgatcagctcattttactgttagtattggtgcgtgaattttttagaacaaagacatacttagttcatcgttactttagactcccttcttccatttttatttctggccttggtccaagcctaccagtcattctctcactttgcttctgtaatgtagaccttcttcctgagaagctggctagatcaggtagtgatcataacattcctaaaccaatagtgctgatagctctgtgtacggagggatatttcatctaaaccattgctctaaacttagacttggctctgagtcagtaatacttctgtttactaggtttgaaatatctccctcttagctgggcacagtggcacatgcttgtggtcccagctactagggaggctgaggtgggaggattgcttgagcccaagagttcaagtctggcctgggcaacatcatgagaccctcgtcttttaaaagaaggaaaagaaatatctcccttttagaagaaacctagaagtctctattttgaggccacttaagatctctgaaatgattttaatgttttagagaattgtttatggtattacctgacctttttttcttgatttgttttctttttctttgttattatcctatgtttaagggagaaaaataattttaaattgagcgatttcttggtataattcttgctaatttttaaatctaatttttagcttaattcttaatttaaactaaaattcttaattttaatataagtggtaaaaaaatacatctacaaagttgtaagttctctcatttatttaccaactgtaatatttaggaaattaatggtcagaattcaataattaaaaccagattccttctgaaaaccaaggaacattataattatctagtatctaattgtatttcacccttttttaaatcttatgaacatcacttacttgcttttttttcttccattctttgtaaagcttctctgccttgctctaaatcagcagttttcatgcagctgttccctcatcaaggtactctttattttcatcatctttgcacgaaaatactgcttaccccacactcatcctgggcacatagcatgagactttactcaccggtccctgtaagctcagtctgccttaggcactttaggaacttgtaaagccaccactttataaggtcttggtacttaacaggaattgcacggccagtgtgtggcctgtcttgtttaaggagctgctaatacccacccagaacaatgaagatgcaatcccatacctggactaacaaaggcaggttaataagaaactcaagagagagttaatagagaaagagcagaatacgtggtttgatgaagtttttttagcttagaaaataacttgttttccccaaatagaaagccaaccccagtgtttcctcagaaattaaagctggctgtctattcaatcacctgtggttaaaaaaaggaatatggccaggtgcgatggctcacgcctataatcacagcactttgggaggccaaggtgggcggatcacttgagtccaggagttgaaaaccagcctgggtaacgtggcaaaaccctctttctacaaaaaatacaaaaagctattcacaggactgaggtggggaggttgaggctttggtgagctgagatcgcaccaccgcactccagcctgagtgacagagcaatactctgtctcacaaaaaaattaaaaaaaaaaaatatatggtcattagttagctataaggactaagatgaaaaaatttgacacatttatgtctaatttataaaagatgccttttcttttattcacctgtaattaatatacaaaaagattacacctaaacagaaaaagaagtgctagcagttggtgaacgtcatttttaaaaattcttttttctttttgagacggagtctctctctgttgcccaggctggagtacagtggtgtgatctcagcttactgcaacctccgcctccccagttcaagcgattctcctgcctcagcctcctgagtagctggaattacaggcatgttccaccaagcctggctaattttttttgtattttcagtagagacgaggtttcaccattttggccaggctggtctcgaactcctgacctcaaagatctgcctgccttggcctcccaaaatgttaggattacaggcatgagccacaataccaagccaaaaattcttatagttacaattttttatatttagctcaaaataaaaatatttctaagtatatatttaatacgcctccatgaatgtatttactgtagcttaaaaataggctgtagctacctaagaagatttattctattttgtgcttatttatattagcttcactcattttacaaattctagcataaaattaaagtcctagtatttgttctaaaactcctttgtatcacctggtcttttacttcagatattaggagcatcttaatttgtggagtaattattttatctgtgtgcaaaaattcttcacatagattattttgtctaacaaccctttgaaatagacaagtctgctgttatccttaattgccagattaagaattacaactaaataagaatattgatccaaacaagtctcaaacctaggtcttctgacatgtttaagttctcctgtatgtaataagagttttctaataagtttgccatattgtatatgaaataaactaaatgcagagtaaggtaacctactagtgctcctgcacaggtggcaggagatttcagtttttattagtctgtcatttttgtagtataacttctcacaaattacctaacccatttttccttagcttttcaagagttaaaagcgattctgttgttttattatttcatgatactattataactgattatttcagtttgggaaaccaaaagtgttttttaaaaatgagtgactaaaaaattgtcaggctggagctacatcactagttgtaaaaatacacaaaccttgatacctgccttcaaggaactcatgttctagcagggaagatagacatctaacttaaataacaataatgtaatctaatccttttccccagctactcaaattcactgaattttggccaataacaccttctagttaggattttgtctttatctggaaccaccacaatttattgaaacatagtactgctgatatactgctgtacagaatgtccagctgtttctgctctgcatgtttgtaattggctgcatgtttgaccacagcatatctgtggggtcatttaagctggcaaatcaggaccacagaagttttagctttatttcctttgtgtggtagcctctgggtttctgtcagtcactttgtagttttgtctgtttgttgtccaccaaaggccagaaaggagagccaatgctttaggggcaaaagagataccagaatacaaaactttaaaggggttttgatgaaaagaagtgcagcaccaaggccttctcactaacttaaaatatggcatatagcaatacaggatgtgttctgtctgcattggagtggtctatcagataatctgagagtttttcctatgggatattgaggtgaaatccttcaccagttcctagagagatttctagatttaattttagaggataaaaagaaagaatgctgccaaaattcttagaagtgagaattatgctgagaaacttaaatgccagaactagatactatgatcattctgtttcatactaccttggctttttcaagatatattttggtgtaaacgtaatgcattttaattgtttttttttaatgactttccaagatttttgttagtttctcctttgatccttacagtaaaacatctttgctgtgaagttgaacttaggaatcacagtcacaccacatttacctatgtgtgatttatacagttgggtcactaagtaggaagaaaacatacattccaaaaacaagaatttagatgaaaaatgaatttgagaaaagaagtagaatatcaacttttgacatagtgttgaagcttttggttatgagggatggggctgacaagtcactcgtacttttacatttttaattaatgtgctcattaggaaaaaaattggaaaattcagaaaaataaaaggaaaaagttacccacaatcctatcattctaagatagataaccactgtttattaacattttggtgcatttccttccagtttcttttttttatatacttgaggtcatagtatgtgaacaactttatagcttgttttgtaccctcaacatttaacaggagataaataaggcctttaaaattatttgaggtttgacggttatttgcttcacaaaacagaaagtggaatgttcttagcacttttttgaagataccttcaccctagtgacttcatctacattactacaatttatgtaattgtaattctcaggaataacactgtgcccaaacagaagcattgccacccatgtcatgactgttttcccctcagagtaggccatggtctagtagtagcaagacacacaagaacgagccccagggtagcagattgctggcagagagtcacagggccttcctagtggtcatccatgcttcatgcccctcctgcatgcgggccagctccaagttgtttcaaacctttgtctttttaaggtcctagttttgcctgaatcttattttctattaaagaaacaactcagaattactggacttgaaacttgtaggccaaatgcaaatttgaggaaatggaaggtcaaatacgctgacaaattcataattttaagtggaggatgccaaagggaaaaaaaaaagttctatcttttcaactaaaaatattataccactctctggagatcagggattgcatgctttggggctctgaattacaggtatctagctatcacattttaaaatggaagtgttcagttcattcagtattaattgaaaataatttttcaatgtattgaaaaaataactagattttacaggaaaacaaaaatgaataataatgatctttacccttctcagtgcctttactcagtagaggaagatggatgtacaagttgtagaatcataggcaagttaatttaaaagcaaggaaggagaaagtagttctggcaagagacagaataatgcatcatgaaggaaaaggatatgagaaaaaaaaatatgggttgaattttatcttgtagagatacgcaagacaattaaaagagcctacacaaacatacatcccaaagaagctcaaggcacattccagagatcatgagcagctttctttcagttttgttatttcttttgtaaatagctctggagaggatgcaaataaatatacagaagagaatttaaatagaccagaattctgttacccagagaaaagttccatgaatgtttctagtcatctttctatgcatatgattagattagattagattagaacatgactagccttaaaaaatttaataagggttttaaaaaagatttgaatagaacagattttcagtggtggttcagctatgctcacctcctggagaaatgtcgctgatgtttttccttgcactcatatgcctgatgcagtgcacatgttcataaacagtcactgacaaatgcccatgttcctttgacagcagttcagattttcaagacagcaaatctctgttgagcacgtgtaaaccaggccacgtgcttacagatgcctgatactcttgagtcgaattcagagctgaatccaaatgaaagatgagtggctcctagagggaggtcatcccaagttcatttcctgttcatgagccaacaaataactaactgggtagatctatgtacattttctgtaacataatgaatacttcttgacttgaaatattactttttgtccaaaaatggaaatttttctattctaagatttaaaatttcaatatataaagaagaataaagtacaaattagctgaaatcttgccatacagaggtaaaatatattttttagtcctttggcttctgacagagataaaatattttggcagatgtttacccagccctacgccctctccccacagtgtgtgggtgtttttttcctactccaaaaattgtggtcatctttttgtatcagtaaatatcaatcagtaatgtacattttgatacaaattactaaaacgttctgcagctgtttgctttcccgccaaaatttatgccagcagtaagtataatcagtctaattttgggggtaaattttattgatgtttaacagaaaagttcacaaattgcaagttttcagcttagtgaacttttaaaatgtaaacacacttgaaaatccatcatctacatcaagaaacagaacattaccagcatcccaagaagccatcctcatgcccccttaagtcactacttccgcaagggtgaccacagtcctgttacccaatttgtaatctttcctaatgtgatagataaaaataaaaatcttattttagtttctggttacttttctgaagttactgcttagattatttataatattaattggggtggggtgcagtggctcatgcttgtaatcccagaactttgagaggccaagatggaaggattgcttgagaccaggagttcaagaccagccttggcaacatagtgagactctatctctagacagaattttaaaattagctgggcatggtggcatgcacctgtagtcctagctgtttgggaggctgaggcgagaggatagcttgagcctggaagttcaaggttatagtgagctatgatcacaccactgcactgcagcctgtgcaacagggcaagaccctgtctctaaataaataatcaatcattgttaggcccaggttttggaggtttaatctcctcctcaagagaaataaatggcatctgtttaaggttgcagaatgtgaaatgacttggcatagctgaaaagaagcaaagattctacagtatgacctttgtgatatattattttctcagtaaatagtttctttgggataggcactgtgattaaaaaaataaaagcatcttgagttttctttgaagtgacaaatttgctggaaagatcagtactttctgctgctggagagtatattctgtttataaacatgaatgaggatgtgaataaggctagaagatgacctctgctggaagtttctggtatgatttggaggaaggagcactagtcttccctggtggctgctagcctttcatttagttcaagcctgccagcctctagcttttccttgcaacttgtcttttcatttttcttgtgctattttctgctatgatagcaaactttgcataacaaaatgtgaagttttccatgtgacattaacttagtaaacattttagcaattgactattaaaatgaaatgtgcataaacaatttgccaggttgtatcttatcacaaatatagtcatgtgctgcataacaacattgcagtcaacaacagaacacatatagacagtggtcccgaaagattataatactgtatttttactgtaccttttctgtgttagatatacaaatagttagcattgtgttacaactacataaagtacacaatatggtaacctgctgtacaggtttgttgcctgggagaaacaggctataccatatagccttggtgtgtagtaggctatgctatctaagttcatgtaagtacactccacaatatttgcacagacaaaatcgcctaatgattgtttcctagaatgtgtccccgttgttaagcgacacatgactgcaatgaaattcagtcctggaaggaaaagaagaagtaactggctgttctctttttctccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 1464 - DNA, 282751 bp, Homo sapiens; identical to SEQ ID NO: 1463

SEQ ID NO: 1465 - DNA, 127838 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaacttt

SEQ ID NO: 1466 - DNA, 1249864 bp, Homo sapiens
ttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattacccagcccaggctacacctcgcattttcaataatagccatcagataaggcagattttttttgtctgcaagctgtaagcctgctgctgctgcttcctcctacacacccatccaagcgtcaatcttgaatgatgagagcagtcaaaacaaatgcagaaaatagcaagattcaaaagcaaaccaaagtgcttaaatctgaattgaatcttcatactggttatacgttacagagctatttgttgtggaattttacgtttcaaaagacaccaggaaatgcgaagcttgaactatagcttataacagagctcacgacaggttccctttctccttttcctttctttcctgtcttttcttcttcctttttaaatggagcacagataaacgtttctgatctgaagctttgcagtgtttggagaataattattctgtttctttaccatgctatagcaaaataagcctctccgagatatatatttttttcttttttgaaatactgcaaaatacagaaactgcatcgcaatcttgaagtcaagataatttatttcttgtttgcatggtttcttccaaacaaaagtattattaggcacaagaaatcctttttcccctctgatatttataacccaatctaccagggttaccattctaaattagctataaaggtaacattaactggatagattttttttttaataaagaagatgagccctaacccaaaataattcaagaataacagatgtaaatgtgtgagttttactgaatggcagatagactgagtaatttatttaataattgggagaaaccagggattaagaatagaacccacaggactagatcatcagaagaaacagactcttaagattgggagagaacttgcagaaaggttagtctaaccttcttcctaacgtaggcatccctggctaaaatgttcctagaggaatatcttccaacttctacttgaatactgcctgtaacagagctcttactacttctcacgaagcctcaatttattagaaagatatttcacttcctaccttgcttctactcactgctccagctctgccttcggagaagcacagattgagaacagtgcctcttccacataaagagctttaaaatttaaagataactctctcatccccccagagcagccgcctggcacatagtaagtgcctaatacaaatttattgaataaatgaaacatcgcttttcttttttcctcaaacctcatctttctctgtttcctttctctttttaagggcattgtcaactttcctggcacacagacattaaacctcaaaacatcttctactcctctttcactactgaaatcagtccccaaattctatcatccctcttcccagtgtgatccattcccttgattctatttcctgttttaagtttacagaactgccacctacattgattttgttctcatagttcaggcccacctagcctagtgaaacaacgacttctatattgatctttctacctctaatatttaaaaaatcaattttatgcatggtgtcagaataatccctttaagacacagttttgattactactccctgtctcaaaacccttctgtggttttctgttgtcttcaaaatcaactcccaactcctctgatgacattttggggtcttcatgattgactgcagttcatctaactttatttccacttttccactgccccagacaggcaggattacttgctggtctctaaaggcagcccataatgggctttggttggttttattatgtccccacatttctgtccatttgttggctttgaatcagttgctatttccattatgaaacctcttctaatcttctctaccacgaataaatctctttcttctctgtcttaaatggcatttttagaccctctattgtaacagatattttctgccttcaattttagttgtttgtgtctgacttattttttgaaagcaggcaatatgctttgctaatatttcacatagtaaagattcagtacatacctgctaaacaaaataatgtaatttcatgatccaaagtacaaaaaattctattttcaaatttaaaaaaagttttaactctatcccaagtctctaaattatttatttaaaataagataacttgttttttaaacagattttttcatgtctgtcttttagctcatcatcctcatccactttttgaataagcagccctgggtggactgcatagtacttgattatattttgttgctgattggtcctggatcttttaataacatcaaagagtttgtagtagtttatgaatcaattttaatagattctagttgctcaacattacctataggagaagctaaaaacaagatactatttgtccctggccagctctaaagctgttacaaggtggaagaaaaggaaagtctcaattatagcttctcctaggatcacagccacagtgcttcacctggtcattttgaattataaatagttgaatatactacatggaaattgagcaaacacgacaatgacactttggcttggcaaggcacatgctgattggccagctcttcaaacctgtttcatctgttaaaatgcaaaccaggggccaagtacctggcagagcacgatacacatcctgcttattaaataaactttgttaaataaatgcctgagtaactaaatgaataaatgatattggaaatgcctttcttgagattctcatttcttagtacagagagagggaaagagggagagggaagaaaaaatgtgtgtgtgcacaaaacatagagagtggactaatagacactggagactcagaaagggggagggtgggagaagagtgagggatgggagattacataatgggtacagtgtacactatttgggtggtgggtacactaaaagcccagacctcaccactttggatatatccatgtaacaaatctgcacttgtacctcttagagcaataaaaataaataaaattatatattacaaaagacagtatatttgtggtggggattatttcaaggttcagactgctatataagaacacaactcagagaaaatactggttatgaactactttacaaaatttatatagactgcctgaattttattcttttaggtattcaatccttcaatttttattcaataatttttacatgttgacaaaatgttataatatatggaggaagtgagctgggagaggatggggtgaggaaggtataaaagagagggaagaaggaaaaaaaagaagaccctgagtcatgttgtttgtttgcggttttgttgaagtattttctcatgagtcaaatctctaaaagaatcttggttcaggtctgaagatcactctgtaacagtgcttaaatatattactctctttacctaaaatacttttatggagtcttaaaattcttaaagcataacaacacactaattaggcaggaacttttattcaactagaatgtctttaagttccaaaagtgagacaagaggagggaaagaagaaactgaccattattctgggctaccatgtcctaggcagtgtggtgtgaattattatcctgatttaccgtaaggaaactgaagctcagagtatgtggtgaaaacaggaattttctttgtcatagtcttttaaaaaataataattctaggggttttactcccataatggcagtgtgaggagctccacaggtccaagccccagtcaaaaaacttaacttgaaaattataaacaaacaatcaaaaaaccctacacaatcagaaaccaaaaacaatgccaacaaaaaccaaccatcaaagtctttgcaaagtgtcctaagagcatataatgtaaaaatgtttattccaaagacagacactaaaacttggtaaaaacagattctgagattctgtagcacttgagccatagctccctctggcccctccttccctgcaactcatctccatagatgctccactttggatggatgtgtccaagagaaagggctccccttctcctcaaatcccaaccaagcggcatgggatctcatcaaaaggagcaggccagcatttccaatttcctctaaatctaagctgtagaggttcaattcctggtgagtgtggctgagaggtcaggggctcctttcttccacccagaccccattcatagaatagaaagttcatcccagctgggtcaggccaaaaatactgggatcttcactgccctcgactgcttacatatagggtagaggttccatgcccagaaaggtaaactaggaagaccagaggctatcattcttgccccatgcctggaagagtggctcaacgattttgcttaaagggagagtcagtttataagaacaaaaagctctaaagctttcccccaagaggttgacttatttgtttgttttcaatttttgttttggatttagggagtatatgttcaggtttgccacgtgcgtatattgtgtgatgttaaggtttggggcatgaatgatcccgtcaccaggtactcagcacagtacccaatagttagtttttcatacattgtccccctccatccttccctactccagtagtccccactttctattgatgtcttcttcatgcccatgaatacccaatatttagctcccacttataagtgagaacatacagtacttggttttctgttcctgcattaatttccttagaataatggtctccagctgcatctatgttgctgcaaaggatataattttttttctttttttatggatgcatagtattcaatggtatatatgtaccatgttttctttacccaattcaccattgatgagtactcaggttgatgccgtgtctttgttattgtgaatagtgctgcgatgaacatatgagcacagatacctttttggtagaatgatttattttcttttggatatagacccagtaatgggactgctgggtcaaatggtagtttgttttaagttctttgagaaatctccaaactgctttccacagagtctgaactaagtgacattcccatcaacagtgtataagtgtccctttcttctgtagcctcaccagcagctattattatgcctcttagtaatagccattctgactggtgagaaatggtatctcattgtggttttgatttgcacttctccgatgatcagtgacgttaagcattgtttcgtatgtttgttggccacttgtatgtcttcttttgcgaagtgtctgttcatgtcttttgcccatttttaatgtggttatttatttttatttgttcaattgtttaagttccttatagattctggatattagatgtttgttggaagcatagtttgtaaatattttctcccattctgtaggttatctttttactctgttgataatttcttttgctgtgcagaagctctttaatttaattaggtcccacttatcaatttttgtttttgttgcaattgcttttgaggatttagtcataaattcttccctaaggctgatgtccagaatggtgttttctaggttttcttctaggattctttttttttttgagatggagtcttgctctgtcacccacgctggagtgcagtggtgctatctcagctcactgcaatctccgcctcctgggttcatgccattctcctacctcagcctcccgagtagctggaactacaggcacccaccaccacaccaggctatttttttttttttttttgtatttttagtagagatggggtttcaccatgttagccaggatggtctcgatctcctgacctcatgatctgcctgcctcggcctcccaaagtgctgggattacaggcatgagccaccacgcccagcctcttctaggattcttatagtttgaggtcttactttaaatcttgaatccatcttgaggtaagttttgtatatggtcaaaggtaggggtccagtttcattcttctgcatatcgcaagccagctatcccagcataatttgttgcatagggagtcctttcctcattgcttatttttgttgatttgtcaaatatcaggtggctgtaggtgtgcggctttatatctgggtcctctattctcttccataggtctatgcatctgtgtttgtaccagtaccatgctattttgtttattgtagccttatagcatagtttgaagtcagggaatgcgatgcctctggctttgttctttttgtttaggattgctttggctattcaggatctttttggttcaacatgaattttagaaaagttttttctagttctgtgaaaatggtagtttgataggaatagcactgaatctgtagattgctttgggaagtatggccattttaaccatattgattctttcaatccatgagcacagaatgtttttccatttttttgtgaaactgaggttatttgacacagagtgtgcggaagtttaagcctaaacgtgttatcaaaatcaatggaggttacacagtggctcattcctgtaatcccagcaatttgggaggctgaggtgagaggatcacttgagtttgagaccagcttgggcaacatagcaagccctctatctctacgaacaattaaaaagtagccagagatgatggcatgtgcctatcatcccagctactcgggaggctgagatgggaggaccccaaggctgcagtgagctatgattgcaccactgcactccatcctgggtaacagagcaagaccctgtctgtaaaaaaacaaaccaaaccaaaacaaaaaaatcccccccaaaacccagtggagatattctggtgacaaacaatcaaaaagtggctaatagctacagtagggaaataagctaaatggtaggttagctagttttaaagaaacagagaaagacagttatgaagagccctgttgaggtcaaaagaaacttcaaatactagcttcaaaaattcctccttctcaaatttaattggagcagactctggagcaatttatagctgacggattgtcaaaaacaatagagcaatcagcaggcaattactggagtctaatatctggatgtgatatcaaatgagatagacaacagaaagattaggaaaagagacaaagagagccctgctataaccactgccatcccaaaactgtgcagatggccaaggctacacccttgagaggataaatacaacgtgatgcatccatactattgactattacttgacaataaaaataaatgaagtgctgatatatgctgcaaattgcatgaaccttgaaaacatcatgccaagtgaaaaaaaaaagctagttataaaagaccatatattgtataattctgtttaaataaaaggtcaagaatagacaaatctatagagacagaatgtagattaggggtttcctagggctggagaagtgaactgtggaaagtgactattaatggatttagggtttctttttagagtgacgaaaatgttttaaaattgtgatgatggttgcacaactctgtgactacactaaaaacaactgaattgtaccttttaaatcagttacttaaattatatatatgtatttatatagtatatcagtagatttaaaattattgaatgatgatataaaataataaaaacaaatcttaaaatttctttaaatttacaagaacaaaatgcacatacataattgtatataaaacattggggttgtttaatatatattggtagttttagtgctctgggttttttttcttctttagttttcttggttaccccttcctccattcttgtcctgcaatctgcatcatccatcctccctgcaaggttattcatgttaataaactggtatgtatattcatatatatttacccattttcaaataacacacacacacacacaaaggcagatatgttcggatatatacgtatatgggagagtatttttggcatggtttcatcaaaatgaaattataccactcacttttctgaaccttagtttgctcatttaacatcttataaaaattctactggccgggcgtggtggctcacgcctaatctcagcactctgggaggccgaggcaggtggatcacaaggtcaggagtttgagaccagcctggccaatatggtaaaacctcgtctctactacaaatacaaaaattagccggacatggtggcaggcacctgtagtcccagctactctggaggctgagggagaagaatcacttgaacccaggaggtggaggttgcagtgagccaagattgtgccactgcactccagcctgggcgacagagcgagactctgtcaaaaaaaaaaaaaattctactaagtaaatgagttttaatttattatttgttggttatttgtaaaaagttaaaatagttatttttagttattttcaactttttaaaaataactacataatagttcataatgtggataaaccacagtttattcagttctttgcctgatatctctaggatatctttgcctgatatacatccttttattttctttttttaaagatttttattttgaaataattgtcaatttgcatgaaatgatagagagagtgattctggatagattttcttcagttttctccagttgtgacatcctgtatgactttagcacagtatcacaatatcacagccaggtcattggcactgaaaaaaatccactgaccctgtttatatgtcctgtgttttacatgcactctgtgtgtgtgtgtgtgtgtgtgtgtgtgtgtgtgtgtttagttctgtacaattttatcacacgtgcagaccacgtggccatcatcacagtcgagacaccgacagcaccatcataagaatccctcctggaacttttttttatggccatagccttcttcctccctttcccattttttgacccctggcaactactgatctgtgtccatctctatcattttatcatttcaagaatgttacatgaataaaatcatatattatgtaacattttggaattgggatttttcattcagcagaattcctctgaaatccatacaaattattcagtgtgtcagtagcttattttttcatttctgagtagtattccatgatatggatgtaccgcaccatttacccattctcttccagagtggctgtaccattttacattcccattaatagtatacaaatgatgcagtttctttgcatcttcactagcatttggtgttgtcaatttttttatgtagtcattctgataggtatgtactaatatttccttgcggttttaatttgtatttccctcatggcttactatgttgaacaaaatcttattgcctgtatctttttgttaaaacgtctgttcatgtcttttgctgttttcttcattggattgtttttctactgttgagttttgagaattctttacatagtctagatactaggaatttgttggactttttatcaatttttttatggatcatgtttttggtgtctatcccattatttttaactttaaaaaatgagcatttaaaaatgtgtctcataaatagcccagagctgtaatattttaatctgaagttttaaaatacaatctctaatggcttacattttaatgggcaaatacaatttggagtaatgacaatcatgcttgattttatccattccatcttatgttcttatttatttacattgttgtttcctcattttccttttcttcatttttggtactctggtaacattcttattcattctatttttctctttttaactttgtgactctgagatacttctctattcctttcaaggttactttatttttccctgctctaatgatcagatatatacttttctatgattatttgaaaataagttaccaattatttccctctcaaaaacgctctatatccttcatactccagtaaaattagaccctcagaatgttttcctttcttcgttctctttttcctacaaccacatgtgatctctggaatgcttttcctttacccatctgccttattcccaaccagttcctaggttttgctgataatcatttagtaaacattttcctagtcaattactagaatttcctcacagtatattcctcctatttaaagagtctttatttaatatttatgttgcacactcccagttggtttatacatttcagtttagatttaattattgtaaagattcattggtcaccactatttcatatccttataaccatcttaatcttgaggtttctgtttccatttgtttgtagtttagttagaatagtttctcatatattcagaaaatattttaaactgattaatcataaaagcagagtgaatcacaatttgtgagatgcaggtaaaatggtacttggagataaatgtatagcactaaatgcctatattagacaggcagaaatactcaccactatactagtaaggaacaatgtctaccttagaaatgacaagaatttcaaatcatttatctcagaattcactttaagaaatgaaagtaagaagaaagataactccaacaaaaataagcagaagtaaggaaataaagatcagaggggaaataaatgaaacaaaagatcaatagagaaaaatcaatgaaaccaaaagctgttttttgagatgattagtccaactggtaaatctctattcaggctgaccaggaagtaaaggagaataaagaagtaatcaataccgggaatgagagaagtgacagcaaaagagtttttatggatataaaaagaataaagaaatgttatgaataactgttagtatcagtaaattcagcaacttagatgaaatgacaaattcattaagagaagcaaggtaccaaacctcactcatgaagaaaagttcataactgactagctctctacctattgaagtaattgtatttgcagttaaaatctttatacaaaacaaaacaaaactccaggcctcaatggctctagtgttaaattctaccaaacatatagtgaaagaaataatagcaattctacacaaactcttccagaaagttgaggagagagaatacttgccaacttattctatgaagccagcattattttgataccaaaatcagatcaagacattatgagaaaagaaaactatatgtattagtgtctgtcataaacatagatgtaaaaattcttaacaaaattttggcaaatagtatccaacaatatatacaggatgatacaatatgactaagtgaagtttaccccaataatgcaaggtctcttaaacatgggagaatcaattaatgtgattcatcagattaactaataaagaaaaaccatataatcctctccgcagatgcaagaaatcatttgacaaaatccagcatctacttatgataaaaactctcagcaaaatagaaagaaatttcttaatcctgataaaaaggcatttatacacaacctacagttagtaccatactagattgtgaaagactgaatgcttttctgttaagtttagaaacaaagcaaggatgtccattctcaacacttctacccaacattgtactggaggttctagctggtgcagtaagttacaaaaaagaaataaaatgcattcatattggaaaggaagcagtagaactgcttcttgcttctattcccacatgacatgattttctatgtataaaatcctgtgagacctacataaaaactacaagaaataataagtgagtttagcagagttgcaggatataagatcaatatacaaacatcaattgtatttccctacactaacaataaacaattggaatttgaaataaaaaccaacataatttacaacagcaccaaaactatgaaattctaaggaataaaactgtcaaaagatgtgtcaagaccaattaaatattgctgggaaaaatcatacaggacctaaataaatggaaagatatactatgttaatgaattggcacagtcaacattgttaacatatctgttcttcccaaatatatctatacattcaatttaatcctaatcaaaatcccagcaggtgctttgtttggtagaaattgtcaagatttttctaaatttcatatgaagtgcaaatgacccagaataaccaaaacaacttcgaaaaaaagaacaaagttgacaaaggtatactacctgactttaacacttattataaagacatggttatccacatattaggatattggggtcaagatagacaaacagatcaatgaaacaaaatagtggtttcaggaatagtgtgacacacagagggtcaactgagttttgacaaaggtgaaaaatcagttctgtaaagaaaggagagacttttaatgaattattctgggaaaatagaatacctatatgccaaaaaaaatttaatccatatctttcatcatatataaaaattatctcaaactgtatcataggcctacccatacaatctaaaactacaaaatttctagaagaaaacttagaaaaaaacttagggaaagtcttaaccttacagtaggcaccagaagtacaattataaaagaaaaaaatgataaacaactaaaattttcagactcttccctttgaaagacaatattaagagaatgaaaaacaaaatgctgattagaagaaaacatttgtgaatcatgtgataacaaatgtatatccagaatatataaagaactctcaaaactcagtattaagaaaataaatcaatttttaaaaatgagcaaaagatttgaacagaatcagagaaggtatatggaagggaaacaagcatttgaaaagaggctcaacatcactagccattaggaaaatgcaaatgaaaatgacaattagataccacttgttagaatgtctaaaatcattgccaaatgatgcgaattaagagaaactctcattccctgctggtgagaatagaaaatgttacaaccactttggaaaagtttgatggtttcttaaaaagccaaatatacatccactagatgacccagccattttactgctgaatatttacccaaaagaaataaaaacatatgccatacagagacttgtataggcatgtttacagcagctttatttgtaatagccaacaactagaaacatcctaaaagtccatcaacagatgaatggataaacaaattgtggcatatctatacaactgaatattactcagcaataaaaaggaatggatagttcatacacacaagacatggatgcatgtcaaaatcattttgcacagtgaaagaaaccagaccaaaagaatacattctgtatgattccatttatataaagttctagagagtataaacttaaatatagtgacagaaaacagatcaatggctccttggggatatgacaagattggtaggattacaaaggggcaaaaggaaacttttggggctgatgaatatattccttttcttgattgtggtgatggtttcacaggtgtgtatacatttctcaagtatcaaaaagggtacactttaaatatatgccgtttgttgtaggttaatgatacctcaataagcctactttaaaaagttaagctgggtgcagtggctcacgcctataatcccagcactttgggaggctgaggcgggtggatcgcctgaggtcaagagtatgagatcagcctggccaacacagtgaaaccccgtctctattaaaaatacaaaaaaattagctgggtgtggtggcgggagcctataatcccagctactcaggaggttgaggcaggagaatcacttgaacctgggaggcagaggttgcagtgagccaagatagtgccattgcactccagcctgggcaacaagagcaaaactccatctcaaaaaaaaaaaaaaggaagttaaaaaaataaagtagaaaaagaaaatacagaatgatgaggagggaagcaacttattttagacagaataatcagagaatgactctctgaaaaggtaatatttaaacagagactcaaaggtattgagggaacaagccattccagcatctaggtaaaagctctaggcagcgggaacagtaaatttgaggaccaatgacctgctctatattgtaatgccatggtgatcctgagggggtgaaactcagtggtacctcaattttggcatgttcttaatatcagtcttcttgtgtattgcatagccattgaagtcctaggagattgagataaatgtgttatttcaggacactgtctgaaaactgtcataactgcattaaaataaacccataatattagtttaggtatctaaaattaatttattcttttaaaagtaaaaggcagctaatattctgattaatttcagacatctcttaattaggttcgagttcattagggggaaaatacttctttttatactttattcatttcttcagcattcactgatttcttcaataaatatttatgttctaagcattttgccaggcggtggggagatagctttgaatatccatgtacttgtggaatttatagccttgtggagaaaatgagtttatcatttagagaaatgtcctttgagatgagagaaattaaaacttagagacatgacttcctattgtgaccacatagagatgagaaatacattagcaaaaacactacctgatttaataggtgttacttggtaaaactctgatgaaacagttaaggtgagtaaaatgatttggcagaggcagcagttaattatgtttgctaagcaggaaaatgacatttggaaaggatgaaggaaaacttctgaacaagagttttaaaaaaaagatgaagaaactggctgaaccctccaaaatgtaataactatctgtttatgctagcatcaaggtgactgacataaggcacatacttttcaaagaatgtgagtctttctagtgatcaaagccatagaaaatagaaggtagctaatatttattgggcacctactatgggtctggccttttatatatgttatctcattatgtaaaacaacatcaaacacatattgagcatttatttactgggagtcagcttctattctaaacgttctacatgtattggctcactttattttacagtaaactagtagtactattgttatcatctccttttatagggaatgaaaataagatacagagaagttatgaattgtctaaagctgcccagttaaaacttgaaccctaagtagcctggctccagagcctaactaagctttcagccactactctatgccgcttctgtgttccaggtgcacaggatgggaaacttgtccttttgcaggagtgagaatgctcatccatacacgtgccagcaagtttgttttaaaagggcttcttggggttactttgttgttgtttattctccttccccccttcaccttacattcattattcttggcttctaatgtgaaaagccatgagaaaaggcaggaggaaataacaagaggtgggagaatagtaaagcccatcacctggatatttttatttcatgtcagcaaagggctctgctgtgattttgaaatattgcagcttcagtgctgtttccacatgggtgctcagctggtctgcaatgcatggatgcctgtgctatgtgtccagaagacagctgccttgatgagatgggggacagtgtggaggtcggtagcccagactctcgagccagactgcctgggtttgaatcctggctcttttccatgatttaaatatttgctgcttctatttttaatatacagcaatagacttgtttctgggggcttagttgttctttggaagagtgaggggggacacctcaccccatctatctcatggttttatttgaagctgaaatgaaatagcacgtgaaaaaagcactgtaacttagagctatctcaatcgtagggatatattgttatctttactgccagtaaaatatatacctgtgttgttcattcagtccctcgaccaagagactggtcctgcgccatcagtgcatttccttgcccagttctctttgtttccaacagacaaaaatgcatggggtgagcagtctggccaaataacaggaaagctaattgtaccgtgaagtgatcagaattcccacacccatgatgttgttgaaggctttgtcttatctaatatgcaccaatagccaggtcttcagcactaagcagcctggtctttgcaatttatctaaaagtaaaaagagaaaaagcaatgtggggccaagagtggcaaagacaggatgattcttatttctaccgtaattagcaaaagggacaattagttattttaacatattttaaataaaggttggttatttttgaaggtactggtttaaaaaaagcacataatttcttaagaaggctatgcccacattggggaaagaaactgtgtattccactaataactaaagtgctggtgtctatgtgagcctgcctttctgtcttttacatcttgtgatacaggtataggagctaggagtgaatagtattcatttctgtaggacagaataagaaagatctcgactaacaaatctatttttaactagtaagtagcagtatctcatttttccaatcctaggtgtcctctgatctgagaattataaactacatgtccttcttccttatggagaaaaactgacagtaagaattagcaggaaaagagacaacccataagaacaatgcttcctcctgataaaaggatagccattctgaaattcaaaaatagaaatgcaaagcagaggtagcagacaacagaaaaatgaaagggattgtcattccaagaattggggaatgctataggtcaacaaagttctggatcataacgccgagatttaaataggaaaatactccaagattatggtctgatgttaaaatgctaagggaagtcaggagcttggattcaattttccctaaggccttgcattttatttctaactaaaatttcatggagcacttaagaaataccagcctttacaaaacagatctgacaacttatgtgctggggtatggtctaaaataggaaatgaaatttaagcctaaaatgctaaaatcttttggcagacaacaaaattatatatataggccatacctgattggaaaaaaatagtaattccgttgattttgttcttgttttcccttcttttaaggttgctggcaagtgtttgaatccccattgagaagaaggtgatcagagaattaagtcattgagccagtctgtgtgacagcctttgtgttaggaccagggaggaaagggaacatgtcccagcctcaaagattttagagtttagtgaggaggaaattaccataaagaatgatcagtattatattaaagatgtgtgcaagatatataaaatgttgaaggaaggggaggatgcttaacttggcttggatagagagcttatagaggagaccatctaatctgtgccttgaagacgtagtaggaatttttgaggcaaaaagaaggaagatggtgttccaggcagagggaacagcatgtgcaaaggtatgtttgaggaactacaaatgattcattattgctgtacttcaaaggttatatgtgcatgtatgaggagggaaatctgcacagaaatggaggcaggataagtaggaaacagacaatcaagggacttgtgtgccatgaaaaagagaactcttttctttcctgagaacagagagatttgatcaaattgttgttgcacaaacatcccctggaggatgtgggagatagacgaatacaggaaagaaactggaagtggaaaggtatagaaaacctgcaaggctctttctcttaaagagcaaatagacaaaatgacctaactaattattttaggagacagtctttaatgcagaggggcctccaaatattcttagtttcctagaacaaagtaagccctggttcaacagctgactggacttcctgtgaaagaaatttagtctgccatgcctcagctgcagaagtcagacatgagaggattcttcccatagagaagacttggtctaatgttggttcaaacttagcttgatagccatggcaaatgaacactctttagttgctagaagagcaatgttaaaatttcaggtgtttcgtgtatgctttacaaagtgatgaaaaataataacaatttttttaaaaaagatgatagctgagaggattaaagatgttgataaatacagaaagtgcttagaacagtacttgcatatatgcactgaataaatattagtgaaaataaatattagctataacaataaatattgactatatattattagctataataagtatttacctataataaccataatacatgtaataatgtattaataataattggctcctgaatcagaaacaaatttcaaatagtcacctctctgaataagttaggtactatctaaaatccatgaaatctgtgattttgaaagaactcatcaggaaactctggttcagtttttacatccatcactcttcagcagatgtattaagattaagtatgaacacagaagaggcactgaatttatttttttcatcttagcctattttaactgttccgaaatctcatgattagagtaaataccttctgtgatggatgcttatttaccttcttgataaagtcaactggtaaatctctaattcttataaatcagaagccagaaaaatgtctcaacctgaaaattaatgcttatttccattttctactaatattgtgaaaatccagggctaaaaactggtttctgcttcatttttccagcaatcgtaaaatgtttctttgggtaaagtgggataaattttcagagaatttgaccctcaattctgtgtgtatttttcacacttaagacaatcttagaaacttcacatgcaggaaatttaatttatttcatatagaagcattggctgaaaattataacataaaccaaaaacaaagaatagagctggcttaaaaatgttgaattaacagactaaaatatatttatactataatataaacatataattaggtaatttaaactaagcattgagattcataatgacccaaagtctgggggtagaaaaagagctttcttttcttctgttttctatacaactcagagccaacctgggaatctgtcatggacagttatattcaccaccaagcatgtgtccttctcttctgataaccacaattttccttgggggatttaccctctcattactcgtagttcctgtgcttgggaggagtttcttgcctatcatctactgggataggtatatgaccaaaatctggtgctgtcggtggcttctgagatggctgcattgattcttagttccttctactgaaggctttgtgcaagtccctcccacttgaataactttcttctaattaatagcatacctcaaaattgggaagatgtcacttccattattagattacaaagttctgactttgatcttactaagagatcctcttccttgctggtttactaggagatcctcttccttgatgaagcaagattctatgttgaggcccgtgccaaggaattgaagaaaatctatggccaacagccatctaagaaaggaggccctcagtccaacagatcaaaaggaactgaatcctatcaacagccatgtaaatgaactttgaagtgtatctcaggatgagccttcagatgagccccttgccctggcctacacattgactgaagctttgtgaaagggcctgaagcaaggacccagttaagccatgtctagattcctgacccacagaaattgcgagattataaaatgtatgctgttttaagctgctaaattttgtggtgatttgttatacaacaatagacaagaaatgcatctgggtgctttttatgctcccctggccaaaatgtttcattcagagttgaccacatgatccaactcagtacaataaaagttagggtctctctccctctgctgtacacacagggcataagattgcaaagacttaatcttggtggtattggaagtcttacttgaaccatttggagtctgaaaaggaagccaacatagagcataatagagtagaaaaatggaaagaggctggttcctaataaccttttttgagaatccagaatcaagctgcaactgaaacttgaatttcccttggatttttggatatgcccctttatattttacaaatataaaaaaattatattttcaaggtatatgtttttgcttaaaacaatttgagttatgaactaatatactacatcatgaaatagtcattgaattcctcttcttgcttttgtcttgcaaataatattttattctctctataaaacagtgattaattgttaatagagttaagaaaactgatgctcaatgaaggaattctctacttcagtacctgtggagtctaagataaatttttaaaaataaagtgctaaaaatcagctcagtagcatttacatagctagctgatgttggatataagaacattgacatggatttgaattgtatagtcacatgcattttgttttttaaaataatatagagacaaaatttccaacatgttgctttctactgtgtccacagaacccttcattctatgctgaattctactcaaagccaaataacatctttaagtttccatggacattgagcaaagtttcccagattctaccgtggttgtgttacaagttaagtattccttatccaaatgcttgagaccagaagtgtttcaaattttggaatatttgcatatacataataagacatcttgggaaagagacccaagtctaaacatggaattcatttgtgtttcatatacatcttgtacacatagtctgaaggtaatttaacacaatattttaaataattttgtgcatttaaataagtttgtatatcttgagccatcagaaagcaaaggtgtcactatctcagctgcccatgtggacaatctgtggttgtttggcatcatcataattcctgattctgaaattatatgctactgataagcaatctttttttatacttactcaacacaagtacttcatagtaaaaaataggacataccattaatacaggaaaaaataatgtgttcaggttagctaatccgcatagtaccatcaccagaatacctgcatcagctgttgaagaagagcaacaacaaatagttgcaggcttccaggctccacctacgatgctgtgttttgattgaaaggtttctgtacactgtgttttattttttatttatttacttatttttaattttacttttgagaccgagtcctgctctgttgctcaggctggagtgcagtagcatgatctccattgactgaaacttctgcctctggggttcaagtgattctcctgcctcaccctcccaagtagctgggattacaggtgcccatcaccatgcccggctaatttttttgtattttcagtagagatggggtttcaccatgttggccaggctggtttcaaactcctgacctcaggtgatccgcctgcctcagcctccctaagtgctaggattacaggtgtgagccaccacacttggcctgtgttttatttttttaggtgggaagaaacatcagacacaggtgagagaccaggaagtgggtcctccagggatcaggaggcattctactggttggctttttaaaatgtttcctccagagtcatttgcctcatttacaatgttttttgtcttttaagtttctctttgatttcataaactgacatgatttcttgttatgaatgcatgctgctctagaccttcaacaagtccatcacacattttcaccatgtcattataggcactttttcctcagtatgaatgtcatcttcatcattactacgatcatgatcaccttgattcagaaccatttcagctgcttcaggattggtcaatgaatgcacaaatggagcctcaatgttaaaaaaacttcattgatatgcacttctaccagcttactgattgatatagtttgaatgtcaaactatatcatgttgaggtgtaatccctagtgttggaggtgtttggatcatgggggcagatccctcatgaatggcttgggccatccccttagcgataagtgagctctcattctcagttcacatgagatctggtcattaaaaagtgtctggcacctcctcctaattatctctctctcgatcccattttctccgtgtgagatgcctgctccccctttgccttccaccatcaataaaggctccctgagagccccccagaagccaagcagatgccagcaccctgcttcctgtacagcctgcagagccatgcgccaattaagcctcttttctttataaattacatagtctcagatgtttctttattgcaatgcatgaacagcctaatatactgatagactctgaatgcatattttctgcatatgagaggaggtccaaaatcatttttttcacacttgacatatgggaatccttcaaagtaccaatttgttcatcatcatcactgaacacagccatagacaacaggttgtaccaggcatgcaaaactgtctttagtcactatgttccaagtcttggcaacagcatatacagtattcttcatgttaaactcctttacgaaaacgtccatgcccatacctctgttccctgacgctagcatgctgtttaataaagtgtttttatatttccttttcattgacttaagggtaccctaatcacatagctcaatgaatgaagtcacatttgaggaaaattgcatgacataaacttttttttatgagaatttcacctggaggatgagcagaacagttgttaaggaataacaaaatattgcagttgttattcagtacagcttccatgcagtgagcatgagccgctggtacaaaatgtttgtgaaatcaatcaggaaacatgtccctgatgatctatgtctttctgttagcataataacagaatggtaagaaattcactccttgaaaacagcagggacacaagcttttgcttaaaacagcaagtttacacttatgtatgtctgctgcattagcacatcccagcagaggtattacccttggcctccttaattcctgtctaggctgtctcatcagctgtggttagtgtcttcctggggcaataatggcaataatgccaaaacagtgatgtttcatcagcattatagacttgttctagcatcagattttcacaagtgatgaccttggcaaacttgttactaaatttttttttcactgctttgtaatcagcagatgctttactaccacaatctttacaagtctaatgctgtgtctcttcttgaatattcatggttaacttcaattttcagttcattgtgatagatctttgtttgtttcataatcagaataccattaagtggcacgtgttcactgcaacaccaacagatccattccttccatacacaattgagatattccattttggctttatgcagtgtttttctatttttcattatcttctgctcatcactttcagtatagaacttgaacagtttatcctgctatttcctcaggtcatatccagggtcattccaacgccatactcttctgtaagatgcttcacacattcaccaatatccaatttctccaacagcttggctttctgtggcatagacaaacattaattcttcctctttttaaaatcatgattatccatacccacaggggtgtctgtaggccatttggactctttcaacaatatctttttaccacgaagcagagattaagcaaaaaatccacaatgggtaatgcacatgtcttggccccacacaggacatcatggcacctcatggggaacctgctgttggcatatccaattaacacacatgctttcttattacctttgactggcaggcttgttgggggagaggaatctgggcaggcatgtgaatatgttgcaattgaagagggctgggggccctttttacccttggggatgctgaataaattaaaataatttcaggcactatcaactttgttgttgtatttataacaatgcagggaatgtttccccaaccttttaaatgtttgttccctattgttattatatttttctgctttgttcattatttattttatatcaaatatggtttcattgaaaataactttatatgcataatttgcctaatagatcataaataacttaagaccattcatgtaataagataacaaaaataacaatatttttgtagttttagacgtgctttaaataaaatagtaagaacaaaagttcataaaatcttatcgaggtcaaatgctagcccagttgttgatccaaaaccagatatctcttcaactcaccctaatgaactatcaatgactaatcataaaattgggataataaaaataatgctttagcatgataaaggaataccaaatatagagacaatgtagaaaaaaaggttagcagtaataaaataaaccttggctataacattcatttctataaactatagtaattatctagatcaaatacatattatggattgactaagtgtgatgatagaaaatgggcttaggaaggatataaatttagttgaggccgggcgcggtggctcatgcctataatcccagcactttgggaggctgaggtgggcggatcacgaggtcaggagattgaggccatcctggctaacacggtgaaaccccgtctctactaaaaatacaaaaaaattagccgggcgtggtggcgggtgcctgtagtcccagctacttgggaggctgaggcaggagaatggtgtgaacccaggagatggagcttgcagtgagccgaaatggcaccactgcactccggcctgggtgacacagcgagactctgtctcaaaaaaaaaaaaaaaaaaaaaaaaaatttagttatctattttaaggaataaactgaaaagacatgcattgtgtcatttaccttaacaaacagtttacaagagtgccatgcattctctttcctgccatccttcttgacttcaatagcattttgtaaaagatgatggtttagggccatgtaacagctggcttagtatattagctctaggaaattttcttaacaaagagcagactcctaattatgtgaccatgggaaaaactctctatgaatctcctttctcatctataaaattaggaaaatctgtaaagtgagtacctatataatagggttgttgacagattaaatgtgataatacttaacaacagtgctgacatatgataaatcctcaataatgctaactgtaattactattataatatcactgtgactattgttatttattattagtatcatcaaaattatttggcatttaaggttctccatcatttgggcttaatcaaccccaactgcatttataataaaccctaggctgtaacattcatttctatgaaccctttcctccttgttatgagaatgcttccttctatttattcattacctgcctcatggcttcttgcttccctgtttttgttcatgctatcctttctacctataataatctgtggctccctcatcctttttgccaatttcctcctggctttgtgctactgatcctttgaggtcctttcatctcctcagcaagaatttctaggatacttccagttttcttcttcttataaactcccatagtacattatttatgcctcttacaaggcattttaaacttttgatactgttaaaaatgtacatatacattgcatatttttcacaagactttaaacacctagatgatggaagccatgtcttaaccatctctgtgtcccacacagtacctagcagaatgccttgcacaaagggggctaaacagatattctaaataaatggtgattataggaatcagacatgtaatttttgcttcattagaagaatcttctaattaactggactaagcagtgcttactttcccaaaaagttgattatagagactcactgttggaggtttgtttcttaggtaatcaaggctgatcactggatttctttgattttcccaagattggggctaatgcctgaaattggggaaagttctttgagggaaagggtttttttttttttttttttttaatctgaacgaaatttcaaaaaagggaatgcttcttacttgaccaaaattgaaagcaccatgggataaaaatttctgagttatgagtctcaggggtccaaacacaaaaccccaaagcatggcctcttggtttgctgactactttgaactgaaggacactgaaagtgcctcagaagcaaggtctttctgatcctctcctgccttctttctccctctccactttctcccccaaagcaagccataaaacctaggaaggtctctgacctcctcccctccctactgactgtcctcatatgacagatgtcctgtcccatatctggggtgaatctgaacaaacaggcctaagtttctccccagtttacatccattagagtatactgttttctccaaccatacttctacatgactatccattcttcatcaaatctaagcataaaaatatagctttccttgggtttgtgggtgttcatttctgaagccttgtgtgtcacataaactttggttaaataaattcgttatgcttttctcttgtcaatccatgttctgttatagggatgttaaccatgatccttgcgataagttaggaaaaagaagccttggcttttttttttggctcccaataccttgctcacagaataaaactttataatttctcataatatgtttttcttttgaaagccccaaccatccactgagcttgaaatctatgttttatttctgaaggctcattattctagattttagctttcatttggacaatgatcaaagagaaacaactttcacagcctcaaggtaaaagattgtaaacagcaaattagtgaacaaaagtatttttctttagttttatcttaaatgtataagaacaaaaaccaagatggccttcacaagagaaaatattccttttccaaataatattggctaatttgaaattttcatattcaaacaaatttaattttgtgagtgggaaaaacattttttcaagagaaagttttaggtattttcttattttttatttttttgtgggtacataatgggtgtatatacttatggggtatatgagatttttcatacaggcatacaatgtgtaatgatcacgtcagaataaatggggtttccatcaacagaagcatttattctttgtgttacaaacagtccaagtacactcttttagttatttttaaatgtataattaaattattatatttaattatataactaatgatagttaccctgttgtactatcaaacaccagatcttattcattctttctatttatttgtacccattaatcatctccccttcctccttatcctcccactacccttcccagcttctggtaaccatatgtattagtccattttcacactgctataaagaactacatgagactgagtaatttataaacaaaagaggcttaattgactcacagttccacatggctggggaggcctcaggaaacttataatcatggcagaaggtcaaggggaagcaaggcacattttatatggtggcagggcgtagggactgccacacacttttaaaccatcagatcttgtgagaacttgctatcatgagaacagcatgggggaaaccacccccacgattcaatcacctcctaccagttccctcccccaacacatggggattacaatttgacatgagatttgggtggggacacagagccaaaccatatcatcatcttactctctatctccatgagttaaattgttttaatttgtagctcccacaaataagtgagaacatgcaaagcttttccttctgtgcctggcttattttacttaacataaggacctcctgttccatcgttgttgctgcaaatgacaggatctcattctttttatggctgaatagtactccattgtgtatatgtattacattttctttatcaattcatctgttggacacttggttttttccaaatcttggctattatgaatagtgctacaataaatgtgggggtgcagatatctcttcaatatattgatttcctttcttttgggtatatacctaggagtgggattactagatcatatggtagccctacttttagttttttcaggaacctccaaaccgttctgcataatggtggttctaatttacgttcctactaacagtgtacgagagttcctttttctccacgtcttcaccagcatttattattgcttgtcttttggataaaagccatttaactggggtgagatgatatctcattgtggttctgatttacatttctctgataatcaatgatgttgaacacacttttatatgtctctttgccatatatatgtcttcttttgagaaatgtctattcagatcttttgctcagttttaaatcaaattattagattctttttcctgtagagttgtttgaggtccttgtatgttatggttttaatcccctgtcagatggagggtttgcaaatattttctcccactctatgggttattaattatatgaaatatttagaaagaaaacaatagttgcatccatatctgaaaaatttagagacactgatgacatgatgaccttcattccctaatgtttttatggatgatctagatatcacaagacacattaaagaaactacactgtagggaatattcaacagttggattgagcttatgcagcgtttcccaaagttttagaaattccatcagataacaaaaggaataatgtccaataagaatcattggtcttaggtgcagtggctcatgcccgtaatcccagcactttgggaggccaaggcgggcggatcatgaggtcaggagtttgagaccagcctggccaacatggtgaaaccccatctctactaaaaatacaaaaaattagccaggcgtggtggtggtcgcctgtaatcccacctacttgggaggctgaggcaggagcatctcttgaaaccagaaggcggaggttgcagtgagctgagatcgtgtcactgcactccagcctgggtaacaagagcaaaactccatctccaaaaacaacaacaataacaacaacaaatcattggtcaaggaagtttgggaaatagagggcaaagcaggttaaacagatttctttaatgtagatccctgagactttgacatactaattttcctcatgaatctccaataagggttatacggcattgatgtttcctgacctcatatggccaaggattactcttgacttttttctgtcagagcaccttgaaggactgacaatctatgaagcacattttgggaaactcatgtctaatattatatacaaaggaggttaatgacaatatgcaatgaaaaattaatcaaaatgcagtttcatataaatcaaatatacatttcacttataatatcaaatataaaaaagacatagtcttgaagtaaaatgagccttatcatctcaaatgggtaatctggatattaattcacctgttgtttagaatcttattcattaaacaagcactcagtttttaccttctttgtgacaagcactgtgttcagtaccaagataataaaagatgatagtaacacaatatatcttcccatttagattgcaattccacagagttctaaaggtactttctttggcaaaatagttcaaaaaatatgtcaagagactatatcaataagttattgagccatagactattaaagaagtgggaggtcaatagaggagagataagaaggtttcatggtgtgcaagattggaatttggcctagaggactgataggaggtacagtttagctccatttgggttcaagcatagaacatgtacagaataaagaaaagacttagggctacaagttcatattagaaacatcccctagacctagagttagagatctagattccaattccagttctaaaagtcacttgctatgtgaccttagctatcttgtctatctatagattatggaaaataatgcctgttttgtctatttcaaaatatcattaggagaaaacacctatagatagcatagtatgttgttaatttttggagttcaaactatatttatctaagttcgtcaagagttagtgcaaagcattgcttacaatgtatcctcaatgaacatttatttcatgaaagaatgaatggataaaagaagttagacctgaatttcctctgccacttactaactaggtcatacatgaccttagttaaattacttagtcaccctgagcctcaggtttcgtatttctaaaatgagggttaaaaattatgcttatatcacaagattgctctggttaaatggaaattgatgaaaaattcttagcacagtagttagtatatacttttcatcacatatacatcctatatattggataattaaagacaattcatcaaatataaagtacagtgattgtgtttatgataaaaactatcacatagcagagaaggagaagtgagtgttcaacatgtagttgtgaactgacacttttggtccaagagctgcatcagaacacgatgagtgacacacaatgtgcaccataacatcaccaagaatgtgagtttaaaaagtatcagatcattgactgattcttcagaaggatcctagattaccatgccatttaaaaatatgtgtaagaaaagcagagctcaaaaattatgtatgagaggctttccagtgtacgttgagcctcaaaggaataaaataaactgaaatttagacatttactcacaacgattggtatagctcagaggtgataatctctggaaagagtattgataatgttaatcattttatagattttaaattggtttgtgttctactgggaaccaaagaagatgtcatgaaggtggctggcaagatggacgaataggaatagctctggtctgcagctcccagtaagatcaatgcagaaggtgggtgatttctgcatttctaactgaggtacccggtttgtctcattgggacggttagacagtgggtgcagcccatggagggcgagtagaagcagtgtgaggtgtcacctcacctggaagtgcaaggggtcgggggactccctcccctagccaagggaagccatgaggaactgtgcagtgaggaacggtgcattctggcccagatactacgcttttcccatggtcttcgcaacctgcagaccaggagattcctccagtgcctatgccacaagggccctgggtttcaagcataaaattgggcggccatttgggcagacaccgagttagctgcaggagttttctttcataccccagtggccctggaacaccagcgagacagaactgttcactcccctggaaagggggctgaagccagggagccaagtggtctagctcagtggatcccacccccacagagcccagcaagctaagatccactggcttgaaattctcactgccagcacagcagtctgaagtcaacctgggatgctccagcttggttggggaaggggcgtccgctatgactgaggcttgaataggcggttttcccctcacagcaaaacaaagctacaggaagttccaactgtgcacagcctactgcagattggtaaagctgctgtagccacactgtctctctagattcctcctctctggcagggcatctctgaaagaaaggcagcagccccagtcagggccttatagataaaacttcatcttcctgggacagagcacctggaggaaggggcagctgtgggcacagcttcagcagacataaatgttcctgcctgccagcgctgaagagagcagcagatctcccggcacattgattgagctctgctaagggacagactgcctccttaagtgggtccctgacacccatgcctcctgactgagagatacctcccagcaggagtcgacagacacctcacacaggagagctctgactggcatctggagggtgcccctctgagatgaagcttccagaggaaggatcaggcagcagtctttgctgttctgcagcctctgccgctgatacccaggcaaacagggtctggagtggacctccagcaaactccagtagacctgcagcagaggggcctgactgttagaaggaaaactaacaaacagaaaggaatagtatcaacatcaacagaaatgacatccacaccaaaaccctatcagaagtccaaaggtagataaatccatgaagatggggagataccactgcaaaaaggctgaaaattccaaaaatcagaatgcctcttcttctccaaaggatcataactcctcgccagcaagggaacaaaactggatggagaatgagtttgacgaattgacagaagtaggcttcagaaggtgggtaataacaaattcctccgagctaaaggagcatgttctaaatgaattgctaactagaataaccagtttagagaagaacataaacgacctgatggagctgaaaaacacagcacaagaactttgtgaagcatacacaagtatcaatagccaaattgatcaagcagaagaaaggatatcagagattgaagatcaacttaatgaaatcaagcatgaagacaagattagagaacaaataatgaaaaggaacaaacaaagccaccaagaaacatgggactatgtgaaaagaccaaacctacgtttggttggtgtacctggaagtgacggggagagtggaaccaagctggaaaatactcttcaggatattatccaggagaacttccccaacctagcaagacaggccaacattcaaattcaggaaatactgagaacaccatgaaggtactccttcatgagaagaacaaccccaagacacataattgtccgattcaccaaggttgaaatgaaggaaaaaatgttaagggcagccagagagaaaggttaggttacccacaaagggaatctgataagactaacaacgtatctgtctgcagaaaccttgcaagccaggagagagtaggggagccaatattcaacattcttaaagagaataattttcaacccagaatttcatatccagccaaactgagctttaaaagtgaaggagaaataaaatcctttacagataagcaaatgctgagagattttgtcaccaccagttctgccttataagagctcctgaaggaagcactaaacatggaaaggaacaaccggtccagccactgcaaaaacataccaaattgtaaagaccattgacactatgaagaaactacatcaactaatgggcaaaataaccagctagcatcataatgacaggatcaaattcacacataacaatattaaccttaaatgtaaatgggctaaatgacccaattaaaagatacagactgacaaattggaaaaagagtcaagacccattggtgtgctgtattcaggagacccatctcatgtgcaaagacacacataggctcaaaataaagggatgggggaatatttaccaagcaaatggaaagcaaaaaaaaaagcaggggttgcaatcctagtctctgataaaacagactttaaaccaacaaagatcaagagagacaaagacgggcattacataatggtaaaaggatcaatgcaacaaaaagagctaactattctaaatatatatgcactcaatagaggagcacccagattcataaagcaagttcttagagacctacaaagagacttagactcccacacaataatagtgggagactttaacaccccactgtcaatattagacagatcaatgagacggaaaattaacaaggatattcgggacttgcactcagctgtagaacaagcagacctaatagacatctacaaaactgtccatcccaaatcaacagaatataaattcttctcagcaccacatcacacttattctaaaattgaccatataattggaagtaaaacactcctcagcaaatgcaaaagaacggaaatcataacaaacagtctctcagaccacagtgcaatcaaattggaactcaggattaagaaactcactcaaaaccacacaactacatggaaactgaacaacctgctcctgaatgactactgggtaaataatgaaatgaaggcagaaataaataagttatttgaaaccattgagaacaaagacacaatgtaccagaatctctgggacatagctaaagcactgtttagagggacatttatagcactaaatgcccacagcagaaaacgggaaagatctaaaatcaataccctaacatcacaattaaaagaactagagaagcaagagcaaacaaattaaaaaggtagcagaggacaagaaataactaaaatcagagcagaactgaaggagacagagacacgaaatacccttcgaaaaatcaatgaatccaggagctggttttctgaaaagatcaacaaaatagaccactagccagactaataaagaagaaaagagagaataatcaaatagacgcaataaaaaatgataaaggagatatcaccactgatcccaaggaaatacaaactaccatcagagcatactataaacacctctacataaataaactagaaaatctagaagaaatggataaattgctggacacatacttcctcccaagcctaaaccaggaagaagtcgaatccctgaatagaccaacaacaagttctgaaattgaggcaggaatgaatagcctaccaaccaaaaaaaagtccaggaccaaacggattcgcagccgaattctaccagtggtgcaaagaggagctggtaccattccttctgaaactattccaaacaatagaaaaagagggactccaccctaactcattttatgagaccagcatcatcctgataccaaaacctggcagagaaacaacaaaaaaagaaaatttcaggccaatatccctgatgaacatcaatgcaaaaatcctcaataaaacactggcaaaccgaatccagcaacacatcaaaaagcttatctaccacgatcaagttggcttcatccctgggatgcaaggttggttcaatatatatacaaatcaataaacattatccatgacataaacagaaccaatgacaaaaaccacaattgtcttaatagatgcagaaaaggccttcaacaaaattcaacagcccttcatctaaaaactcaataagctaggtattgacggaacttatctcaaaataataagagctatttatgacaaacccacagcccatatcatactgaatgggcaaaaactggaagcattcccttagaaaatgggcacaagagaaggatgccctctctcaccactcctattcaacatagtattggaagttctggccagggcaatcaggcaagacaaagaaataaagggtattcaaataggaagagaggaagtcaaatgcctctgtttgcagatgatatgactgtatatttagaaaaccccatcgtctcagttcaaaatcttcttaagctgataagcaacttcagcaaagtctcaggatacaaaatcaatgtgcgaaaatcacaagcattcctatacatcaataatagacaaacagagaggcaaatcataagtgaactcccattcacaattgctacaaagagaataaaatacctaggaatacaacttacaagggatgtgaaggacctcttcaaggagaactacaaaccactgctcaaggaaataagagagaacacaaacaaatggaaaaacattccatgctcatggataggaagaatcaatatagtgaaaacgtccatactacccaaagcaatttatagatacaatgctatccccatcaaggtatcattgactttcttcacagaattagaaaaaacagtgctttaaatttcatatggaaccaaaaaagagcccatatatccaagataatcctaagcaaaaagatcaaaactggggacatcatgctacctgacttcaaactatactacaaggctatagtaaccaaaacagcatgatattgttacaaaaacagatatacagagcaatggaacagaacagagtcctcagaaatcataccacacatctacaaccatctgatctctgacaagcctgacaaaaacaagcaatggggaaaggattccctatttaataaatactgctgggaaaactggctagccatatgcagaaaactgaaactgcacccccttccttacaccttatacaaaaattaactgaagatggattaaaaacttaaatgtaagacctaaaaccataaaaaccctagaagaaaacctaggcaataccattcaggacacaggcatgggcaaagacttcatgactaaaacaccaaaagcaacagcaacaaaagccaaaattgacaaatgggatctaattaaactaaagagcttctgcacagcaaaataaactatcatgagagtgaacaggcaacctacagaatgggagaaaatttttgcaatctctccatctgacaaacagctaatatccagaaactacaaagaacataaacaaattttcaagaaaaaaaaaaacaaataatctcatcaaaaagtaggtgaaggatatgaacagacacttccctaaataagacatgtatgcagccaacaaacatgaaaaaaagctataatcactggtcactagagaaatgcaaatcaaaaccacagtgagatattatctcatgccagttagaatggtgatcattaaaaagtcagggaacaacagatgctggagaggatacggagaaataggaatgcttttatactgttggtgggagtgaaatgagttcaaccattgtggaagacagtatggtgattcctcaaggatctagaaccagaaataccatttgacccaacaatcccattactgggtacatacccaaaggagtataaatcattctactataaagacacatgcacacgtgtgtttactgcgacactgttcacaatagcaaagacttggaaccaacccaaatgcccatcaatgatagactggataaagaaaatgtggcacatatacaccatgtaatactatgcagccataaaaaggatgagttcatgtcctttgcagggacatggatgaagcaggaaaccatcattctcagcaaactaacacaagaacagaaaaccaaacaccatatactctcactcataagtgggaactgaacaatgagaacacatggacacagggaggggaacatcacacactgggcctgtcagggagtagggaactaggggagggatagcattaggagaaatacctaatgtagatgacgggttgatgggtgcagcaaaccaccgtggcacgtgtatacctatgtaacaaacctgcatgttctccacatgtatttcggaacttaaagtataataaaagaattggctgggtgcggtggctcatgcctgtaatcccagcactttgggaggccaaggcgggcagatcacgaggtcaggagtttgagaccagccttaccaacatggtgaaaccccatctctactaaaaatacaaaaattagctgggcgtggtggcaggcaactgtaaccccagctactcaggaggctaaggcaggagaatcgcttgaatccgagaggtggaggctgcagtgagccgagattgtgccactgcactccagcctgagtgacagagcaagactccatctcaaaaaaaaaaaaaaaaaaaaaaaaagtcacatattgtgatcataacagaggtaggtgtttgagctggtactcttattctgagaagcatccattggctttgatacaaattttattgttaaaaatgatttgaaaattgaaaattgtcttgcttgatttccctactatctttgaagtattttcagttcaatactttgaaatatttcagggttcaataaatcaatgagacatatggattatctagggagaatctatttgtttctctaggccattgaactgttggaagcacattaattattcatgatttcttctgattaacaaatttgtactatctgaaatacatgttcagtactattcaatactttattaaaagttatattatttactcctaaaaaccagagttgggtacataattatttcttttgttagcattttagagatataaaaggggcttatttctaataacaacgaagattaaccattacacaaggcattctagaaatgagtggtcataatatcacattttaaataattgaaaaacgtatacaaatatatgttgcccaaaataaagcatgacgtcaaccatctgttataatataacactgcattttcttacattctctaggtaaacattatagggactattatgtaaaaaaattccaaattattctaatagctctattcttaaaaccattaagaagattatctctgtttttaatattcaatataataaatacaatttgagtgcaaaagtttaaaaagttttatactatattttatataataataacttatgctactttactctcctagtattgcaagctaaaatcttttaataccaaagttactgaagaagagaaaaatttttaaattaacactttaatatattctgtcttccatctcttagacaacctgttgtcaaattctggcatctcttcctacttcttcagatttgacttttctttggattcatattgcataccttacacctgcaataaattatatatacctttaatatgcttattccttgtacataacagctatagctactgttgggctcagaacatgataccctgaaatatggcactttggcaattgagaagactgcagaagcaggaaggttgcttttactttctcctccctttttcttctaaagaacattcataaagagttatcgacctatctcacctgaatgtaggtcataagaacctcacaccacacaggtcctaccctatacccagaaactaagaaaaatctgaacaaagaggtcctggtaagttccttccagtttattacaaatagttcatatccactttttgtccaattatacatctacacaactgttcattcttcattaaacttaagtataaaaatacaattttttctggttctttgggtcttcatttctgaaggctcttgtgtcatgcaaaactttggttaaatacattatgcatttttcttgttatcttgtcttatgttgtaggagtgtcagttgtgaaccttgtgatgggtgaggaaaagatacttctttttctttcctagaatactcaatacatgttatatgaatgaattgctcatctgactttcttcctggcctctctactcagccactgaatctctggggacctagtgtaagaagacagattttccatgtatttctagttcttttttttttttttttttttttttttgagatggagtcttgctctgtcacccaggctggagtgcagtggtgcgatcttggttcactacaacctccacctcccaggttcaagcgattctcctgcctcagcctcctgagtagccgggactataggcgcatgcccccacacctagctaatttttgtatttttagtagagatggggtttcatcatgttggccaggatggtctcaatctctttacctcgtgatccgcccgcctcagcctctcaaagtgctgggattacaggcatgagccactgcacccagccatatttcaggctttaaatgaaatggaatatatattttttaaaggtaagtttaaccagaatacatttattcatgggaatttttttatttacacccatttgaagactaagctacatttgaaattgatatcatattgcataaacatatgaatacatgtatttgtctaacataaagtcttcaataaatatttagtgaatgaataaaagtatgttatactcaacataaatgagtttaggtcatttcctgatgactttgaggggtcacagatgtgctggtgctttccttgacacaactttctcttacccctttagtttaaatatatatatttaattattttaaaaatagagtttcatattttgagttttatttaataaaacagatcatcaaactcataaatgaagcttgtaaaacattttggaatgacttcatccacaaattttgaggaatgaaacaaaaaagaaatggatattaaaactcttaagaggccaatcaaccatttgtgttttgatattattagcaccccaattcaaacacacaaaaggttaaaaaataaattataaaacaactggggacatttggacatcaagtgggtcttggataatattaagcaattattgtttgatattccattaggtactgtaatggtattttggttattttttaaagttgttatttttacatgcaatatattaacagatgagatgatatttcttagactttcttcaaaataatcctgtgtgtatatggggagtgaatgcttggtatagaaggaaatatggttatttgttgataggttttgaagttgggtgataggaacatggatgttcataacaccattttctttacttctgtatatatttgaatttttcaaaaataaaaaggtttttttaatcatgctaataaaactatcagaggaactttgaaaacattggattcttgagataaagtggctttccagaaaaaaagtggcatgaaataaaatgctctcatactttgtttaactgatgtactttatttaaatatctttactatatattattggtttcctagttagctatgccaatatattagatggtggaatcatgacctatagctagctgagaattttaaattttactgactttattgactccatactcttcatggacactaatttagtcagacaagttacagaactccaataacgtaataaacatgttaagtgcctagtgtattaaatctcttctgaaaatctacctttttgatgattttgagcatggatttctaataactgaatgccatagtgtcaaatgttgatttggtcaaagatactgtttttgactggatcaagcaaaaacacttcccaaaatgcagcagcagcacaatctgttatattgcaatgagaaaaaaaaattggcaaggactataaaagttacttaagaaagaacttcacaaggagatgaagcacaaatggaaatgcctcagaaagtagaatgtagggcaaatttctaaggagatcacaaagaaatagcaaaagcttgtaggagttgggtcaaaaaagctcagcaggaaacaggatgccacatctaagaaacatgaaaggaaacagaaaaaagaattcttttactatttcaggaacaaaagaaagctaaatgacacactttgctccttcagtgaagagaaaaggaaatctaatggtccatgatagtaaaaatgcacatgcaattggtaatttaaaaaaatcctccttaaaagaaagataaagtagaattatcgagcatttattgagaggtgcaaaatttaaggcgcaagaaaatatttaaaaaattaatctaacataacttaaccattatgatgtgatttatatgcaaagatacctaaaggattcaccatccacatataatggaatattatgcagccaataaaagttattattaataatattaaaaaagttaataatatgatattaagtaataaatgccaaatcatgttgttgtctggaagagaatcgtcaaattgtcaacagtagtttttgctgataatattactggtgatttttatttttgtcatctatttattcatttgttggatattctgcaatgggaattacttttataatcaggcataacaataaaaatattattcaaagtacctactgtagtctccaacagttcaattccaagtagtccatttaaaggactcttgttaagttgccaataatcactgctttgataaatcaaatggatacttgctcttatttcctggctctgtgaagcatctgacttttttcaatgttccatgctaaaattctctgctcccttggcttggtagttctaatttaaccatgcatcagctgtcacctggaagactgcaatggctggctgtctttactacaagccattctgtcaattaccaccagggcaatcctgaccacattactccattgcttttgcctcttcaaagacttatcttacagaacatagagggtgagttgctctggatgctttctgtttttttttgtttgtttttgttttttttcttttttttaaattttattattattatactttaagttttagggtacatgtgcacaatgtgcaggatagttacatatgtatacatgtgccatgctggtgtgctgcacccattaactcgtcatttagcattaggtatatctcctaaagctatccctctcccctcccccaagctttctgtttattagtgacccaatgaaaagaaaaggacaactttgggtccagggattgtaaattgtgtcctcaaatctctatttcttgcttctgttctctcttaggtagttgtatctcataagcaaaagagcttcctctcagtgacagggatgagagggcagggccacagataattccaggcttatatcatcctacctagcaaccccaaagccaagggagatatcctctctcccattctctgtgtatgaaatccaaaggaaagtctctggttgactaacagtaccacacctaattgctaaggccaagaatgtgggcctgggtcataggtccaatctgaacggagagatattgtactatgattggtagcctgatcagaactacagcacttggaaggtccaagggtaagtgcttcaaagaaaatcagggataattaataacagaaaagagtaaggaatattggaaagatgaaaaaccaaatatcctttataaaaagtaatattcaatctccttagcccaacactcttagaatttcttggattggcctctgctcatgtttcttgcctcatctttcgccattccctcccaagaactccagtttctaactatgccaaacacttggatcttttctgaataggcagtgctaggcagaatagtggcccccaaagatgttcatgccttaatcctaggaacgtataaacatgttaacttgcaagacaaaagatacactgcagatgtgattaagattaaggactttgaaatggaaagatcatcctggtttacctaggtgggcccaatctaatcacatgagtcctcaaaagcagagaatctcttccagattcagataaccagaaatatggcaatgtgaaaagaactccatccaccattgctggctttaaaaatggaggaagaggctacaaatcaagaaatgtgggtggcctttagaagctggaaaatgcaaggaaatggattttttttgaaagcctacagaaagtaatgcaatcctgttggtattttgattttagctcaatcagacttttgtctcactttggatctattacagaactgaaagataataaatttttatcgtttaagcttccaagtctatggtaatttgtcacagcaataagaagaattatacaggccattctatgtcatgctttcttgattttgtactttctggtcatttcatgtaaaatatctatcttccacatctatcttccacactgatgcaccccgctcaatcccagcccacttggtgaactccctacccttattcaaactataactcaggtttcactccttctctaaagccttccttagcatcactcctaggaatatgtgactcctaggaatacttttttcttatggccacacagcactctgcattcttccgctatagtatttaaagtgctgtatgaaatttgtctcagactgtaaatttatattaggccagggactatatcctattcctcaatgtatatcacaggtaaagcatgttgagcacatagtacattttaataactgcttgtgtatgcatgaaaaatcattgcactggttactcactttgagatttatataggaatgagaaagagttgaaaactgaaaaaggtccagcatattttaaaaagagaacatgaatatagcactagggatttaacttctactgccacaaaaatgttggaaatcaacgagtagtaggtcaattgtcaaataacttgaggatagcaggtacatttttattatgagcaaatcttgtctaaattagttgtctaaactcttccttctacatcagtaactgaactgataaatttgggagtaagaaattggttgtaatcaatctttcttgatgtgacaaggctttagattgaattctaaagatcaatgaacttggaaaatgtggtctcttctctaatggcattaattaataacatctaatattatcacctagaatctggccaatacatttacatagaatcagcctgcaagagggtcctcaaatgattcttggcttctcatattcactcccttatgtagtccctcccaatactgaataggtctaacctgtgtgaccaatgggattttgaaaaagtaacaatgtatgatttctgaagatagatcttaaatgaattgctggttccaccttacttttttgaattgctcctacttctaggggatgatagataccatgttgtgaggacactcgagcggtcctgtggaggggcccattagagaaaaactaaggtcttccagcaaaagctagtactaaattgccagctgtttaagtgagccactttcaaagcagattccccagccccagacaaactttcagatgactgcatccctggccaattttttgactacaacctcataagagaccttgaacaataattacttagctgatccactctcaaattcctgacctgcagaaactgtgagaaataaataaaagtctattactgtcttaagtcatgcagttttagataactagttttagataacatgcagcaatagataactagtattctgcctatagaataaaatagacaaaagtcactataaactatttcctgtgttgttagccgtggttttttaaaaacaattattatcctttcactttcagccctagtcttccaaaccaataaacaagagtcttagaaggaagataacttcaaggcacatctgctccttttagattttatactaaaaacaaaataaagagccagtcttattactctactgccaattctcggtaataagtgacatttcctcctcccttgtgtctgtatttttttctactattgaggcacctgaaattggatgatgagatttccaatgtgcccttagaaaatgagaaagacatgacacactgtaactctcctccttataaggctcaggaaagaaatatacctttttgggcctctctattttcctgacagaaaaagagagagagatagaaggtagaaaagctatctgccatccttcagctatgatattcctgaggctcatcatatttttcttattttagagagtctgtagagggacacgtactcagtgtgttatatttgctcctttatgtgtgaccatcacagagcaaatgtcttgatgtcatctcatcaaaagcatcagagatgcttggagcagggagaagaaagggggtaggaagaagagagtgatgaaaaagggcaaaggaagaacaggagagggccaattgtgtagaaacagcaaacagcctgacttgttcaggcacaggccagaactgctcctaggctgttgagttaacacagatacactctggttaatgctcttaagaagatgaattaagtgaaacatttcagttctaacaaaagtggttcctgcaaaaaggagagatggggcacaactagaagaaaaatacttgcattctagtttagttcagtctcttcagagaaggtaacatattacagtggaactacatcataaggtaaatttcaaatcagataaaatatttatgattttgagaaaacatttcacatgaatctataaatacctagcctaaggtttactgctaccatcgtttacaggttaattagcgcattttgcagccttgccataaatctgcttccatttagatagaatggctagatggttgtctttagcatcctgaaatttaatagtagaactatgtagcagattctagtctttctaagcaggaatgacaaaatagtttcaaattattatttttttgtcatcatatgactggtaacatgtcattggcacttaaattttatgagtgtctatttattaggctacagaaataattttgttctccattgctctatgtataggtggggaagctagtgacctcttcaggggtggtttcagaagttaagggggtgtagccaaaacctggtgttatctccttagcttgtctaaattcaggaaagtcactggagaataaaaaagaaccaattttactataagacaatgaagattctaggcagttcttagaaataggtaagaaatctaagctccacaagggcagaagtctttgctctttttctttcctatgcactcaacaagaatttcttgactgtatgaaggagccagggaatgctcagaagaatctgtgactcatcaaaaggtaagaggcactgctgaataaggaaatagagtggagactgcctctctatggagtgccatttgagaagacatctgaaagaaagtggagacacaggctacctggaggaagcatgtagcaggcagtgggaacagcaggttaatggccctggtgtggcagtgagcttgacatgttcaaagggcaataaggagggctttgacatgcaacagagtaagggaagagagagtggcaggaaataagcaagagaggcaggtgagggcctgatcacgcatggtgtaggaggtcatcataagaatgtaggattttattctgaatcatagtaaggtgtcattgattaaagaatgtggtcaggccagcagaataagtattaatagtccatgacagtgacagactgtctttgaaaaacattatttcctgagtggaaaaaaaaaaccctagaaactgaagatacagtcaagtatcctatgagtactgaataaatactcttaactcactggtaggtggatgtgtttgaaaatgattactaaggaacatactgtgttattattcaagctatcatgatgggtatagatttagttttttaaagaaagcttcttatttctggaacagttgaataaatttattataatttccagagacccagtccttaagcatggagttattttagtgtaatgccaacacgctcctgtcttggtttaggtgagctttcaggtgtgcaggcaatttgcatgataaattttgcatgtatacatctcctctctcctttgctgcaaaggaagccaagtagtaaacagtctttcttagtaaatgttttgctgaaagaaaacacacatttacaagtcaaatcatgtgaaatctttgataaggaaaggatgatagcaaggtttattttacagtttatgctgaaaattttactgggaagaaataactaggctggttatttccagttacacaataagcagttactttttaagagctactgtgtaaaataaacactgctaagtggttgtaatatttgacttcattcattcattcattcattcatttatattaactaacatctattatatatgtaccatgtaccagggcactatgctaggagccaaaaataaaagaaaaattttaattacagctacaaataatccacagtctagaagaactcaacagagtacattggcttcttctaattccaaataaaaatagggtcagcatatgtcttcacactatgacaattggcaatagactgttaagcttcggctttctctttctatttcctcttctgcctttctgctgtgactttgtaatcaataggactattagcttaactggatacatcagctaataatccaacaggacaaatgcataattcttagaatcagtttagatggttgcccgcagcccccttctactcatcctctgaaaatgctgtagagttcactccagtgacctaccatccataaaccctctgtggctgttcagatgtttacacacattggctacttcacagaaagtcctatctctctgttaaaagagaaagtatatgtggctgaaatgatggttagttctcatttcagtacttggacgtcaagcagttagtttactgttgcttttgtaacttggaggcattccattctatactgaacacttctttggataaagttctcatctttctaacacattgttagattaaaatagtaatggaaaagtaataatctctccagcctacagacagctcttatgccactacatgtctatagtattgatataacatttttataacatttctgtttcagttatctattgctgtataacaatcaacctaaaacaacaaacactttatttccttgtgatattacaatttgggctaggctcagccaagtgcttcttctgttagtcttgtctgaggttactggtgtggttgtataccaccagtcatgccacttggggacactaggacatctgtatttgtctttattcctgtagtctcaggcttctccctctccaagtgtcctacatcctctccacactctctttctgcaagttggatgagcctcagacttctcaagagttccaagacttgttaaagcttagccccagaattaaaatacattacttctaccactttctattggtgaaagcaagtgaaagagccagcctagattcaaggtgaggaaaccacacaggaatgtgaatacttacaggcatggttcagtggaggtctctaatgtaacaactacacctaccttgactcaaataatctgtaaacctgcattagatctttagattgataaagagtttcaggagggtagggtgagctccttaccaaggggccatgatcagagtcctacctcttttgcgttgcatggttccaacaacacttcatttctagaagtcatcttacctttactcatcctgggccctttgtctgggacagcttttctactttctgacatctattgaagtctttcttctcaaaacttcaagctcaggctttatctcctgccagaagcctttcctgatgctttcaggttctgttaagacctgcttctttctttttttttttttttgagacggagtctcactctgttgcccaggctggagtgcagtggtgtgatcttggctcactgcaagctccgccctccgggtgcacgccattctcctgtctcagcctcccaagtagctgggactacaggtgcccgccaccaagcccgacaaatttttttgtacttttagtagagatggggtttcactgtgttagccaggatggtcttgatctcctgacctcgtgatccacccgcctcagcctcccaaagtgctgggattacaggcgtgagccactgcacccggccaagacctgcttctgagattctaaaatatatcctgtgtttatctctttcacggaacttattatattgtagtaaaatgtctgggcatttgtttatgagtttgtttcaccagctagactgtttacaatctgaagtcaggcctgagtcttattaatgtgattttgtcattctgtaagtgcccagtaataacatgttaaaagggaactggaacaggagaagtgtatgttgtataatctgatgtcaccccaaatccagcataattcaatgcatatattagtggcttaataaatattggacggttggttgaatacataaatctatttctgttagtcactacataagagatataaactcttattttggtaacctggtaaattttcagcaagcttcataaacatttcaattcctagctaggaaagaagcaatatgccttgggcacaacttttcaagtaatatcaatgtttagcagcatcaacctttcaggcaggtgtaaatagctaaaaataaaaattcatatccttctgaaatgctggctaaatttctgaaggaatgtattcatgctctgaaacacaaaaccgttctcttgcttctataaaacagaacaaaacctgtgggaaaccaaattactttgctaagtgtgacaaatccaaactgctacagagcaagagataacataaattaatgggtcttggaggcaaacaccaggagttattttgaggtgagtgaaatccgatctccatcctaaaaccacactgtgtttccatggatcaagtttttagttttatgctttttagaaaactatttatgcacaataattacagccacctgaatgccctaaataaacgtagcccagtaaatgcaggcgtgtgcttgaatggtgccctattgctttcaagtactttgtagtgggctgcatgtctgttttgacgattcccccctaaaacctaaaggcagagatgctggaagggtttgcattaccaggtgacacagtgcttgactttgataagccgttgctaaggcaaagaaactcctaaagccttattgagggtagcccgtggaagtctgtcacactgtcttatattatttttctttggatacaagccatttttctaatttaacccttgattttcttgagggcagtaaagttgtcttaggttcttttcacacagagagtgtttagaaatgtttgtggttgaaatgagtacccttctggattatgtttaccccaaaggagatgcattattttattttaatcagtgttaaagataatgtataggaggccattggataccactgagctcttgtaccaggccccccccaaaaagaaaaacaaaccaaaatggagtcactcatgctaaagttccacatcaccaagcaaaatctaagttgtttttctgaccttccaagaaaccaagagagtgcgagatgatggccaaatctctaaacaagccagttttagctggcaggattagaaattcccctttactttatcctttacaaggaaagtaacatttaaacaatcagtctgctttttgttttctatttttgctttcctcagcccttttctgtgtataaaccaatgtcctcttgctcacctcatcataatggtcattttattttagagaatgaggtactgcctgtccagaactgcaaataaaagcttattaagatctttatactaaatttttttgttgttgttgaaacttaatcttttgacaattctggcaaccaacaaagggacccaaatgacactgctgatgaatcccaagacctcttggggaacgcaggagagatgttactgagcccttttcaggtcccctgtcttcctcacggagccccagtctgttcctttcaggttggactccggtctttttgcactgaatctctggagcttatcagctttcatttgggggttactttgtgctgtaagagagcatttgaccttgaggtgccaagggttagtctgtgctctgagaaggtgcttgacctttgggtttgtgctggctgatgagttactggcaggagctgcagttttaaaggtgactgacaacagttgcagtaagtggttattactgcagggagtcagaactccagcttccaaaattcgtagagatttggtttctatcttcttaattgctttgtcttgagcacttagttgaggcatgcctcaggtgtctgacagggtcaggcagaaactggaaaattattggctaagttggtcaaaggcatctcagtgccaaagccacaatttgatcagtgggcatgatttgggcacttgagagctattagagcaacccaccaccaaaagataagactaccatgaaaggataagctgcatgtaaaatagggtagcacctatcagcctctagaaaatgtccgttcaacaaggtacgctgtgaaagcattatataacccaatgtggcacttccctcttaggctttgatttagactctgagagactcaacattcaatataaagatagttcctaatttataaaaaaactgagcactccacctttcagccacacttgccttttacactttattaggccccggaagcttcaaatacttacaaaaatggccaaatcttactaaagatactttagaatgacaatggccattatatagcatgtttcagatgaacaacactgcatttaagatgtgcatatatcaatgagggttctcaaattaggccaaacccagatgtgcagaagtttctaaaaagatttcaaaaaaaaaatttaatgggctcttttcaaagattgttttacagaaatcaagtgaaaagtttaatgattaattgataagaaaaattaaatctactatccttttcatttagttactcttccaccccgaaggtaaaaagaaagctaaagtgtttctaaaggttaggatctcaggtcaagcaggtttgcttcttttttagagctatccataccgagtccaggcacagagaatgttttctttgccccattctctaatgggctccactctggagtcagtaatgtagttaagaaacaagctaaatggaaaatatagcctattgaactagatcagtctctgaagtacacccttctggcatttagctggctatttggaaactttttgtaaaaaatttacatctataaagaaaaatcactagaaattcttaaagtgagagagagtactggtctaaacaagcctgacctttgatgagtttgtcttaactgggcttcccacctacatctttctttgtctagggtgaatggactcttagaagaatgatggttacgacaaggtctgtctggatttgtagatttcctctcctgtgacaaatgttaatcttccctggttgctggatctgtctttaggcaaataaggaagaatattcagaaaaccctgtcttgcattgtgctattctttaagtgccttcagttcaaagtaatcaatataccaaagtgacatattttggggtgcgattttctgaactactttaatggctatgtagtttaagaagcaattcgagcatgaatgttaagaatgagtaaatttacataaatgtaaatggtataaaagtttatagctgaacttgtcatagtttaaaaagtctttttcagtaactttaactcttaaagtcatgttaaattaatagatatttatgaaatatcagtcattcttaacaaaactaaagtattaaaatattaattgctgaacataagcttaaaatgtatacactttgatatcttgtttttatatcatatagaagagctcaacatatttaagtctgttagtaaacatgaaaaaattgttatatgaggaagcacatgtttctagaaagtataaaatttgtattcctaaaatgtttttgacagacagctcaaaattgcttacttcttaagattccactggaagttaaacttactaagggttaaaaattccaattaatatatgaaagctaaaactagaaataataaaggaagtaactccaaatatgagaaaaataagtaatatttttgctaaataaaactatgaggtatgaaagatgtgtttttgttaaggaagaaagagagtaatttttctcctaagtagaatgactagtttttccaaagtagaaaaagtattgaaaacacaactgaatgaataagaaatttgtagacagtttgttgaagatgaatcttgtgaaaggaactctataagggtgatcaagctggctaaaatgagaaaaaatgttatccatatgtttttctaagaattgagtattaatatcaaaagtatactgatataaaactagaatttgatctcctgtgttaaaaccacaaggttttctggaattattgatctgttcttaataggaaatagtaaaaagtttttctttatttttttaggtaacttgcctagaaagcaaagagtctgtactttatcaagatgattctgtgtgctttgtattgtctttattaggtctttgatgactgagaaaactgaatcctctctattaaagagctaagagtttttcctacaactaggtaacttactgtatttgcctttagagtcttttaattattactctggttaaactaatgactataacttcacagtgatctgtgatcctattttgatcaaatgttttaaaccatttgacattttttataaactttccaaaataaactaaattaagtcttcttgaccttgaattaactttgggaaaacctcaaaggacgtgtctctcaccttttaaaagagagatattaaactagttaggcttatttcatatgttaaattatatggggagtgttccaacaattgtatgtaatccctagaaatatatcagtcctaattctggttattgtgctaaaatgttgtatgctacgggacattgaatatataagtttctgataatgttaaggtcataccattggactgggtgagaagttccagaactctggtgaagaaactggaggcttcatgaaactgccaaccaagatcaagcagagcgagatttacttatgtaagactgaaaaactgatgaagaagagttatggttttttatggctttttaatttgaaacattacttgttattttaatgttttattttacagatttaagaaaagcttttttttaaacctatctatagctttcagcaatgtggtaaagtatacttttgtgaacaaaagttaaaacatttactttttcctctctatttgatctttccagaattcagaaactatttgtgaggattcttgtttttatggcaatatggttatttgcataaattcaataagaattactctctttataacatgatacaattggaaatactggttgcattactaaagcattgactgggatgtcatacctgagaatgcacatagaatgactctgtaggtactgtgggtaaagtctgaagtctgccttggtttggtttcctatcttccagaggttttcaaaagtccaatttgagattccttattaaaggttccagcaaaacaaaactcggaaagagcccaagtggtcactactttttctgcatttatgtaaataatcaggccaagttggatgagattaaacttattttgccaacaaattagtctcactccattttttgtaacaatgagggtgactctagagagaaaaattgctttagaagaaaaactgtagtaccactgttactagattgtagcctctttaactattttttgagtttttactatctgcctgtggactggactggatcctgaatttgtctagtttcctccaatatctggctctgaaaacaagacctgctctctttcttaagccctgtaagatgaagctagacaactcaatataaatttcaagaaacaagtctcatgcttgatgtgtgggccatacagagagttcaccaaaatgcccaatattgtaaccagagacattcaaactataaacaaggatgagaacttgatgatttcatgttgtggacagtgacagagcaggagcatcaccatcttggataagcactgtcattttaaagttcaccttgatcaaaaactgcctaaatccaaaggacatcagcctaatggctaaggtcagcctgatcacaaaccacaaataacatctctgaccaaaaacattccaaaccccttcccggcaagagacatgccagccctcatataacctcccctctggccagagagatgttagccccaagataacctcccctctgaccagagacattccaaccctgccataaacttctcccctacacagaaacattccaagcctgtgataaagctctctcaccctaaaactaataaatactcttagtccctaagagagaatgctcctgaccaaaattggccagaagcccctctcaggtttagtctccaaaataaacctttgactgttgagctacttttcgtgtttctttcctctttctttaactcttatatttggtgccaaatctgtaagagagaatgttcctgaccaaaatcagccagaagcccctctccaaaatatttattctccaaaataaaccctgtctttgacagttgagccacttgtcatgtttctttcctctttctttaactcttacagacagcttgtgcccagatgccaaaacaagactctgtatcataatgaaactcttagccctcttaatttttttcttatttatgcctaccattttttgctcagcaggatagacttgtagtaattttataatcagtagcttcttcaagtaacttacaaaattaaatcagattggtcatgtcaaacccagatctttacaaaacctaagggatcctttagtccacccagtgggtaactttggcaatatccctaatgcaattgctgttcaaattgtactagtgttcccttttatagggtaaaacttctagactcacatgtttttactccctgccttgctgacacttcttattgcacatgtataaatatagaaagtattgtagagactccattgcaaaaagttagcaaattggctacttggttaaaatgggtagattccttttctggctcattctttgttctattcaattttagttggtttggttcattaagaccctggctaaggtgcatactccaaactcttggcattcctaatatccttggcattatcgccaaaattcagaaactatttgtgaggataatagcagtctccctggtatactgcattccctcaaaagttttaaatgtttgcatgcagccatctctcaaacttcaaatggtctctattcagctattcagtcggtgtataacactaatcacggtttttgccattaaaagcaatggcaaaaaccacaattattttgcaccaacctaatagaatggcaaaaactcaaagaaatgcatgattatgaggacactataagctatgaatggcatgttgacttcagaaacccagaatggtggtaacttagggctaatgcccctgggggagcatgaccaaaagggggaaattgttaaagaaaatgtataggaagccattggctagcactgagctcctgaactaggcccaacagacccaattaaaatggagtcagtcatgctaaggtgccacatcaccaagccgaaagtaagttgtttatctgaccttccaagaaaccaggagagtgagagataatggccaaatccccaaacaagccagttttagctggcaggattaggaagtcccctctgctttaacctttagaaggaaagtaactttaaaacaaccagtctgctttttgtcatctatttctgctttcctcaactcttttctgtctataaacccatctcctcttgcttagctcatgggaacactgattctactttataaaatgtagtattacctcatcctagcattgcaaacaaaagtcaaatacaatttttaaactgaatttgttataattttgtcttttgacaccaggaaggacccgctccagttctgcctactacttgatcattctcctctttggattaaagctgtgtgaaacacaagaatgatgttgaacacatgacatcaagtggagggcaagccatgctaatttttgtggactggcccattgaagtggtattgagctagaattatagcctgtggccagaggagacctggagctcctttgccttgttattcttcttttcctgggggattagcaacccaagcagacagtttctttccttccaggaaaaccccaaacctcttggtgaagtgacaagaaatattcaccccagcgcacatcttcctaagaaggcccaaggcagaatgctagctctctcagtagttcccaggcaattcaatctgccacaaagtacaatgtagagcactgtgctacagggaaaaacaagcaaacagaaaaggaaaaaagtccattctgcatactgattttgtctaatgtggcatttgcacacttgggcggctacagtacttccgtgctgctgccagattaattcttcccaaacactgctcagatggtatcactcctttggccccaaaccttcactagggttatcgcctaaaaaaggtagcctgggagttaaaagtttgccatggtttggctcaaacttatatttccatgtgtcagtcctattatttcaaattccaaccaacaatcttctataatttttttcgtacttttccatgcctttacacgtgtagagattttttttttttcacttgtaagtcaaaagcctagctaggcatcaaattccaacagctgactttccccctatgcaaacatactctgaccttgccagctgacagaagtatttccctcccctgaactctgctaacactgctttgtcacagcattgcattttctttcttgtctggtccatgtttgttcaatctgctggacctataccagtgcctactgtattatgggtactcaataaatgttcattgaatgaatattaatttttacttattgtggtctttgcattgatggtttctttgtaagccaaatataacatttatactaacttatcatttttgagggtcaaagacaatttccaggtttcaagaaatgagggctctggggtctcttcaacacttgcaggcctagagctggacttgtataccttgagacttccctgctataggcagatgtcattgaataatattagtgtgctctatttacagagtgcctacgcttgtgctaaatcacttcacattcatatccctagttctcctagtgacatactgatgatgcctatctcatttttagaggaaacaaacaatgttcaaagatgaaggtcctttcccagagttgaatgtaaagtgagtaccagcgtcaggattcacacctaggtcagtctggctccaaatctagcttttttcctaccatcccacattccttctttgaattgcttcacagtttctatggaagtttctgctatttctctgtctttgtctctgaggttcatttccactcctgcagcttcacaaaagcccaattacacctgccagtgacctgctttgtctaacaggatttttgatggctatagcgtcatttcagcatccgcacggcctgcttctctctacccagagcacagctcccaggaggtgctggaagcctggcagcgggtcatttcagcagcttgtttttaccacttttcagcacaaactgctttatttcaaacattgctcatcactcacctgcctgcattcccccttcatcttcccttaagtctgtctcataggcctgtaagtagaaattgtggcaactcccgaagtctagcagcactggggaagagtagaaaccttactgtcagacttgctaattgaaaatttggggagaagtccactcagacgtgtctaaagcagattacctttgaagtacttacaaagaaaggttttctgagccttgaggtccataatggggatgtgtatatggagagcgggaaaggagctctttatactcagagagctgaactatttgcaagtgccaaggccttcccttgagtatggttaatgaatcaaatagaaatattatttcaccagttctaacatgcccatttatttttcatcttaacattctgtaatgggaatgtggcttacatagacagtggtagaaccattatttgccaaatagcagtcatcatagttgtttctgccttcacctgagtatcaaatacaccagcaataacatttgcagaataagcaggagcaggggtaggctagctctatgtaattacaaagctcacctaatttagtttttcataggattttagggaatgcttcacatcaaagctgttggtggcacagaggacaatactgtgtggaaaaacttgggcctcaatgaccgagcgaaaattgagtctactcagaagattcagatttggacccagaagaagttttagaaaaatttgaaccaatttacattacttatttttttatgtgtgcccaagaatggcataagattcaaaaaaaaaaatctgtctaaataatatgttagcactctttcactatatatgatataaaaattctagcttatgtaatagttaaattgatgttttcctctgatgtagtttaaaaaaagtttaagcgtacatgggaaataacttatacttttacatcagattggcttgggtttaaatttaggtttcatttcttattagccttgtgatatggtttggctgtgtccccacccaaatctcatttgaattgtagctcccataatccccatgtgtcatgggagggacccagtaggaggtaattgaatcatgggggcagtttttcccgtgctgttctcatggtagttaataaatctcacgagatctgatggttttataaggggcagttcccctgcacatgctttcttgcctgccatcacgtaagacatgcctttgcttctcctttgccttctgccatgattgtgaggcctcctgtggcgtgtggaactgtgagtccatgaaacctcttttgctttataaattacccagtctcatagcagtatgaaaatgggctaataagagtaaactggtaccagtagagtggggtactgctattaagacacctaaaaatgtggaagacactttggagctgggtaacaggcagaggttggaacactttggagggctcagaaaagacaggaagatgtggtaaagtttagagcttcctagagacttgttgaatggttttgaccaaaaagtccaggctgaggtggtctcagatggagatgaagaacttattaggaactggagcaaaggtgagccttgctatgctttagcaaagagactagtggcattttgcccctgtcctagagatctacggaactttgaatttgagagaaaggattagggtacctggtggaagaaatttctaagcagcaaagcattcaagaggtgactttggagctcttaaaagcattcagttttattcattcacaaagatatggtttggaattggaacttacgtttaaaagggaagcaggctattgcttcagagggtgcaatccccaagcctttgtggcttacatgtggtgttgggcctgcaggtgcacagaagtcaagaattgagttttgggaacctccttctaaatttcagaggatttacggaaatacttggatgtccaggcagaggtgtgctgccggggcaaagccctcatggggaacttctgctagggcagtctggaagggaaatgtggggtcagatcccccacacagagtccctactggggcactgacaagtggagctgtgagaagagggccaccctcctccagacctcagagaggtagagccactgacagcttgtaccgtgtgtctggaaaacccacagacattcaacaccagcctgtgaaagcagctgggagcggcactgtatcctgcaaagtcatagggctggagctgcccaaggccatgggagcccacctcttgtatcagtgtgccctagatatgagacatgcagtcaaaggagatcatttttgaactttaaggtttaatgaccgccctattggattttggacttgcatggggcctgtagcccccttgttttggccaatttctccaatttggaacaggtgtatttacccaatgcctgtaccctcattatacctaggaagtaactaacttgctttgattttatgggctcatgggcagaagagacttggcttgtctcagatgagactttggactgtggacttttgagttaatgctaaaatgagttaagactttggggaactgttgggaaggcaaaatggttatgaaatgtgaggacaagagatttggaaggggccaggggtggaatgaaatggtttggctgtgtcctcatcttgaattgtagctcccataatccccatgtgtcaagggagggccctggagggaggtaattgaatcatgagggcaggattttcccatgctgttctcatgatagtgaataagtctcacgagatctgatggttttataaagggcagtttccctgcacatgctctcttgcctgccaccatgtaagatgtgcctttgcacttcgtttgccttctgtcatgattgtgaggcctccccagctatgtggaactgtgagtccattaaacctctttttctttataaattacccacataattcttcatagcagtatgaaatactcaggtatttcttcatagcagtatgaaaatggagtcatacaccctgggaccctgggcatattacaaggtcttaatgagagaataacatttgtagcatgtggctaataattgctatcctgcaagctttattaaatcatttcttttatttgttaaaacgttataaacatttagttttactttagtttttactagaaagttgtaaatacacatttctttttttaaaaaaatctataattttcttttctagttgattttgaagcttcagtatataaagtagcatgtattttacacatgagctttgctgtcacttaactgagtaggaaaaaaccaacagtacaggaagtttgatggagtccaaaatcttagtagagatctgtgggtttccccttaaatattggtgaaaatataggatctgacaaggccctgtcttgtctcttttaagaaggcatagtttgatacaacatcatgccttccaggatttcataactgaattttcatactagaatttttgataggcatatggctgtccagccaaagactacatctcttagcttcctttgcagcttggcgtggccgtgtgactaagttctgatcaatggtatgtgaggaggaatgagctacgcaactttgggtcatgccctgaaaatgaagatgcagtcctcatcccctgtctattgtctgaaatatggatggatggacatagctgaagacattttattgggtcaaagatggaagctgtgtgttaaaggtggcagaagagcaggacaaaaataacatgggccctgatgattttggagccaacatatcaccttggaccaatgactcagacttcaatgtgagagataagcaaatttttatcttgtttaagccactattattttgggcctctctgttacagcactaaaaaatgtacgttaacctctccattttcatgtttctgtccctttcattcactcctccccctgaacaacacgacttaaagtcactcatgtgtgccaatctcataaaaaggcttcttctgagttcctattctgagaacctgctaaatttccttgaaatctagttgccttgaagttgctagtcctcctccctggtgaatggtgtcttgccctaaagctaagccccaatacccatggaaatgttttctcaaaatctggttcctgttcattctgactgcctggatgttccattatgtttcctacctcctcttaagatcctcagcttccttaagttggacccaatactaattataaccttatattggcttttcctttccttgcctatgtgatcttttttgttcatcacattccaccagcaaagtccagaggcagcattttgaatagacctggtcccttttctcaatctctttcagtttttttttggccccagaaaatataactgatcccttgtctccatctctttggcctttgagctgaaataactagaagaagcttgccaaagcatactaatatatgtaagttgttgagtgactactgtgtaagtgtcccattttagggattacctccaatccttataacaaatctaaaaagaggttgtattattccccttatacagatgaagaaactgaggctcagagtgaataagtgtcttgtccaagatgcctcatctagtaagtaatgaatcttcaattaaaacccaatctataatcttttcactatataggctatcttctaagcccaatgttaagacaagggcacagagattagggctcatgaaaaagaagacattctctttgtgagaatgtcctaccatgggtacacagattccaaggatgtgaggggactatctagcaccatactctagaggccatattaacaccaggatgctaatatgaaagtttcaaagcttcttggatgaaaagatgctctccttctaacttctgctttttgaatttaaaaaaagtcatttttctcaccttttctctcctaggattcttctgtttccctgaccttgattgacatttctccctaagtcctctgaattattatggaattaaatggcttattttaatttccctaggtgtctttattgaattctttcacagtgttttatggaaaatatctgattacgaattcatagaacagaacattatgagattctttgctaagtggctgccacagtagtattcaggtcctgaagcctctgcaatctctgtttctgtatacaggctcagaaacaaggaggcaagctaagttccagcatcttgcagttgactcttttatatcacctcctgaacaattcctaaacagaaaatactgtccccaaccccctggaaagattcatgaaatattagaaagcaaatcattttaacacagaagttaagatcttgggttctggaatcaaactgggtttgaatctcactgcttctgtttaaatgaccttgggtaagtttcttaatctcactttccctccatttcatggtctgtaaagtgggagtaacacctacctcacagagtattcatgaggattacatgaactaatagtgccaagctcataataagtgccaacctaaaagttaactaactatatcttttataattaagaagtaggagagtcttgttaaacctagtacaaaataccatagcatgtgaaagattctatgagtacctgcacctcctaaccattttctgacctatatacgtattatacataaacatgaaatcatatgaaaccatgctatttagcagaattcctctaattcagcttgattgacacaaataatccacaatgtggaggtgtcctgagagatcagatgattccttcagagaagagggtgaattctcattagagatctggtagttccagtctagatgagtcaccaatgaatagatttgctatgggttaatgttccgcccagcttgactaaattttaggcaggtttcttcctgactattggctcctaacctcccttttcttagagcatttactttacaaaacttgcaattataaattaggtctctggccctttgacatgtaaatcttctcccagtctctcactgattttacatcctaaaaatgccctttccaaggacctagaaaccatccttttgaaatatgattatcaaaaaagataatgtccttatcttctcatctctgtggaaggataggaggctgatttgataagcaccgacaaagaaacaagattttccttcaaagtaaggaagtatgaagaagtggccttgtagggagtgacagacatggctcagattcaagcagatcatttagtcattatagagaagttaaatattcctctcttacaggttagctgggctttaaaatcacaagaaaaaagtcaaaggttacaggcttttgtgaaaaagtacacaaaaagatgcctttcacaatgacagtcaactcaactctccaagcaatgcctagtttctagaaacttccagatgaagaccagccatttcagtctctgaagtcccaggggtgtgctgggatcttccacccactcagaaagcctctttctaagaattcagtctttgagcatagctgttagctagaaagaaaattccagttgatgtatgaatctatagaaccagtcattctcatgccctctagggataaactaggcatctccaaaccctgaaggaacagagtggtggtgagtggtgttcaaatattttaaaagtattggagtaccaacaaggacatactggttaggagaatatgagctcccaaaatggatattagacacattattattactttttgagatggaatcttgctctgtcgcccaggttggagtgcagtggcacgatcttggctcaccacaacctccacctcccaggttcaatcgattctcctgcctcagcctccagagtagctgagattaaaggtgcatgccaccacacccagctaatttttgtattttgagtagagacagggtttcatcatgttggccaggctggtcttgaactcctgacctcataatccacctgccttggcctcccaaagtgctgggattacaggtgtaagccaccatgcctggcctagacacattataaaggtaaataattataaccatgtgatgttgacacatgagtaaatatgaataaattcagatacctaaagggaatgcagtagaaattaagtaaaaaacaaaatataatttggcatcaagcatacaataaaagtagcatttcttttttttttttttttttttgagatggagtcttgctctgttgcccaggctggagtccagtggcgtcggctcactgcaaactccgcctcccaggttcacaccattctcctgcctcagcctcccaagcagctgggactacaggcacccaccaccacccccggctaatttttttgtatttttagtagagacggggtttcaccatgttagccaggatggtctggatctcctgaccttgtgatccgcctgccttggcctcccaaagtgctgggattacaggtgtgagccactgcgcccggcctaaaagcagcatttctaatcagtgaggatgacaaggactattaattcattcaataatacaggaacaattaaatagtcatctagtaaaaataaagtttgattcatacctcattccttatacaacagtaaattacatagatcaaatatagaaaaacccaaaccataaaagtactagaagaaattataataagattcttatataatctggaagtgagggaggcctttttaataataatacaacattttgaaaccattcatttaaaaaaggcttgattaaataaactacaaagtaattttaaaaatttgcatggtggccgggtgcggtggctcacgcctttaatcccagcaccttgggaggctgaggtgggcagatcacgaggtcaggagatcgagaccatcctggctaacatggtaaaaccctgtctctactaaaaatacaaaaaaattggccaggcatggtggcgggcacctgtagtcccagctactcgggaggctgaggcaggagaatggcgtgaacccgggaggtggagcttgcagtgagccaagatcatgctactgcactccagtctgggtgacagaggaagactccatctcaaaataaaataaaataaaataaaatttgcatggtaaaaatcagtgtaagttaagttgcaagtaaatgaaaaactgaggaaagataattacaacttgtatccattcatggggctatatggctaataagaaagagctcctttgcccttcacatcaatagaaatagaccaacagcagctcccagaatgggccaaggcattttgaacaggcagttcagagaaaaggaaatacaaatggaacttaaacatatgaaaaaaagctcaattttattcataatacaagaaacagcacaaagatactacttttcacctaccaaatatgtaagttccaaaaatttgataatatgctatattggtcaggacataacaaacttttccttatattgctgctgatggtataaatcattgtaactgctaaggagggcaatttggcaatacttatcaaaagtacaaacatccctgaaccagcaatttaacttttgggaatgtatccatcacacatatgccttcatatgtgatgtataaataaggttattcattgcagcattgtttataataagaaaatatataaaccattgttattgatagggagatagttaaataaattaaggtatattaataggattattattattttttaaaattttgcaggcacataaaacattcacacaactaaataccagaaagtgctctatgttctactgtggaaatatctctattaaattaaattaatgggttaaaaaaacaagataaagaacagaatgtagagtatgctaccattttttatatagcttaaaaatgagagataaagagaggaaaaatatatttttatatttgcttgtacctcggttaaatatccctggaaggatatacctgacactgtgtggttgcctattgggaagagaaatgggtatctgaggtaataggtattatagggagatttgcttcactaaacattgtataaacttttatactttcttacattaaaactctcttggccaggagtggtggctcatgcctgtaatgccagcaccttgggaagccaaggcaggtggatctccttgagttcaaaagttcaagaccagcctggataatacggcaaaaccccatctctaccaaaaatacaaaaaattagctgggtgtggtggcccatgcctgtgatcccagttacttgggaggctgagataggaggatcctttgagctggggaggtggaggttgcagtgagccatgattgtgccactgcactccagccagcatgacagagcgagaccctgtctcaaaaacaaacaaacaaacaaacaaaactctcttatatgacatctcatactttgaaatgttcaatttaatcattttccaaatctggaatatggctcatttttattgagatatgaattgttgttgatctcatgcttgatcttcccaaacagaacagaggctctatatctttctctgagaaactttggtgatatttttagcactgaaagtgggtaagaacacttctaacactggaaattcaaagtctgcagcacttactcttgggacttggaaaaattcttttttaaattaataattgttcatcaatggttccattttctttgcctacaagcatgtttcttccttcaaagtggacatgggtgtgtgcatatactcatctgtacacacatacatacacatgtatatgtgtaaggtattgaaagtaaaatgttttcttttaaagtatgtttgcatttttcctagaattggcctcacagtttccatcagacactcaaagcagtgggtgacataggaaaggttaaatattactaaatagtggacattacaattcctagttattcttttcccctttcctacagctaccatttaaatctaggttggcaacttcccttgggtctaaatcagcagtccccagtctttttggcatcagggaccggtgttatggaagacaatttttccatgggcagggcccagggtggaggatagttttgggatgattcaagcacattacattttttgtgcactttatttctattattattacattgtaacatataatgaaataattatacaactcactacaacgtagaatcagtgggagccctgaacttgttttcctgcaactagatggtcccatctgggggtaatgggagacagtgacagatcatcaggcattagattctcataaggagcacacagtctatgcagttcacaaaaaggttcgcactcctatgagaatctaatgctgctgctgatgtgacaggatgcagatctccggtggtaatgctcgctcacctgctgctcacttcctgctatgcagccaggtttctaacaggccatgggctggttggtactggtctgtggtctgggggttggaaatctttggtctagatgaccttgacagcagtatagctggcctgtctgccttcaggctttccacactccacattatatgcccaaccagccagctgttagtaatcattttaaaaataatttactgcctactttatcaaactagctgtgaagcgtttgactgtacgttgaactatagccaagtgtgctgtatttctgcactcatgagtgagcacttcgttgtcatacttcattgtcctggaatttctctgttcctgtttttattagtggggaaaactctgctgtattaattttgttcacagaataaacaaatttttctttaatatataaaaataaactagaaaacatgttttactggtcacttttcaggaagaaatgcctgtatatattttttaaatttttttttttaggaactttccatagggtgaatgatccatgtttgaatataaagtaatgattttattcagtgcttataaactgtattcaattgcatggagaaaaaagaatacactgacctctaatttaaaagtaaagagctttctggagaggtaacagaataataactaatggagctttacagtttataagtgctttcatataaatgacctcatttgtccccaccaaaatctcatgacaaattgtaatccccagtgttggaggtagggtcgactgggaggtgactggatcatggggggtggtccttcatgaatggtatagcaccatctcctggtgctgttcttacgatagtgagtgagttctctcgtgagatctggttgtttaaaagtatgcagcacctcccccttctctctctcttggtcctggtcctgccatgtaagatgcctatgcttctgctttgccttccgtcatgagtaaaaactccctgaagcctccccagaagcagatgccgctatacttcctataaagcctggagaatcatgagccaattaaacctattttctgaaaaaattacgcagtctcaggtatttctttatagcagtgagagaacagactaatacatcatcactgttattttaaagaataaggaaatgaagactcagaaggatgaagcaatgaccaacccaggtcatacagtaggtaagcgaaaaaccagggcctttaacttaaactttctgacactgtatctcataatctttctcatatggtgagtggctctcccaacattactgttacataaaaatttaggtcatgcgtgtaattttatcaagtatccctcaattcctgggacttaagtaattgatacacagaacaggttaaatagagagccttttctgaaagggtaaggaaaaacaacattgatgtttcagaaccaatgtgtgtttatatcatggaaaaagctagaaatcccagtagaaaagtctttacagaagcactacttatcactgtatacctggctatatataaatcataggtagcatactccccctttccctgaattctaatgaaagcattgttccaaatctattacagctatatagtttttataaaatgacccatggggaaaattctttctagagtttaaaagctggaaaagagtttctttctctacacgccttgataatattgttatcaatataatattatataatattataatgacagttctatagcccacttttgtcttgattatcaagaagctcagagtcaagttgtagtcttagttgtagtcatttttcttaatttgggttttctaaaatgtgattgttaatactgaatgtcaatttgattggactgaaggatgcaaagtattgtttctgggtgtctccgtgagggtgttgccaaaggagagtaacatttgagtcagtggactgggagaggcagatcaccctcaatctgggtgggcacgatctaatcagctgccagcgtggctacaaaaaagcaggcagaataaagtggaatgggcagacttgctgagtcttccggccttcatctgtctcctgtgctgaatgcttcctgccctgaaacaacagactccaggttcttcagctttggactcttggagttacaccagtgatttgctaggggctcttgggccttcggccacagactgaaggctgcactgtcggcttccgtacttctgagattttgggacttggactggcttcctcgcttctcagcttgcagacagcatattgtgggacttcaccttgtgatcatgtgagtcaatattccttaataaactccccatccatcctattagttctgtccctctagagaaccctaatacatggattattttctttgttctcctttttacatttttccttttatactatctagttcataccttttactaccgtttcaatggatttttattttactgtaattatatctttttttataagcctcctcaaatctgttttgaagataggcagagtataaacatacagagtccattctaaggaacatgagcatttagtccattgaaagaactaacaatagtataccaggtgcaaatgatctatttaatctcttgagtagcttccagagaagaaatttctgctgtaagtgcacagggtaatagagtcctgttttctttcttttattcttataataaaagtttgacatcactatcacaaccatttcatgtgtcagtaacagtagatgataggtatttggtattatacaacatttgcttgtgttaaaatgagccctggtatttcacgtatgttttatgattgtgcacatttggtgtgatccaaagagataatagtggaattttctatggaaattcttgtttgatacagaattatatcagaagttgacacaagaatcaatgtgtatattgtctagggtatatatcttacatatataattatatcacatctacagttctgattatcataggaatataatacacatgtcacacggacaaacgtattcattttcctaattgatggctacagcagagaaaaccagtgagtatcatctttgagagataaaaccgtggaaatgtcctttgtggtatgattaatactaaaagggaaagggtaattgggtgagaagttagaaggtgaaccaaaggaagactaagaactttttgtaccgtcaataaaacaaatccagacttagacacggtgagacgtaaaaaaactacatcaacctggagaatgttcctcccttaggattttcaagccactcaaaaatcaatcaaaaaggtttttcttttatagggacggctaaacagaactagcagaaacttagaggtaaaattgagtgacagggcggagctaagcagacatcatgatggggatgatataacaggaaatgttgctgtgatcagctaatttggaatgaactgttaaggtagggtgatatagctagtgtttttgttccctagtgtattgttcagtttcacattgaattgtaatcctcagtgttggaggtggggcctggtgggaggttactggatcatgggagtggatttctcatgaatggtttaccatcatccccttggtgctattctcatgacagtgagtgagttctcacaaaatctagttgcttaaaagtgtttggtacctcccccctctctcgcttgctcctacatttgctatacaaagtgcctgctcccgctttgacaccctctaccatgattgtaagctttctgaggcttccctagaacgcgagcagatgccaggaacatgcttcctgtaaagcctgcagaaccgtgagccaattaaacctcttttctttataaatcactcagtctcaggtatttctttatagtaaggcaagaacagcctaacacagtgggatgtttacattttagtgtttgctcagatttggggcaagccaaaagtcaggagcctgtggggaggagagatgtctgattaaatcttgatcaagccaagtcagtgggcaagaaatgggcaattgtgagcatctggccgggatctgcaacctcatgaaaagtatataccatcaaaaggctaactacttgtttgtcacataaattcttataaaaagcttagtggagccaagaagcaagctaagtataataagagaaactcttcttaccatttgtatcactaatgagcacataattgcagctagtcatgtaagtctcctacaaatcagcgtaaggttaattaagagagttgagacacttaggtgaaagtcacttttgcttatagtaaagaacttatctatcttacagacacatatcacttacattatgtatttgttatattaatatatttaatatatttaaaaaacattgtaaaatgatgatctggcaatatccctagaagaacctcattgaaatacttgagatttattggtcatttgtctttacaaaattgagatttgaaaagctttaaaggaggacattctaccaaagcataactcataaaacagaagataaaagtatgagccatggaattatagagctggaaaagatctagccctactgtttcattttcaaatgaggaaattgagggttattctaaggggttgtttttttaagtcatacagtaagttggtgcagacggaggagtagcaatcagatctctgagctcttttcctctttgacaatgaagttcacgaatgcaattttgtttcataagttatttactttactaaagtaaagtaaggtacagctatgatttattgttaaatgagaagaatgagtgtcagagaactgtatatggcatgatttcatgttcttaaaatacaaacaatatttgtcaatctatctatctatctatattgatttatttatcttctatctgtatgtgattgaatgaaattggagaaatgagtggaagcatatacaccacactaacattgaacatttacaagaagggtaaaaaaaggagtaagaaaaaaggaagcaaaatagaatttggtaaaatggtatgtgaaagtgaagattgcaaaacttttatccataaaattattaatacataaaaattgaatgtgcacatagacgaagactagaaagtcactaggatatacatacaacaagaacataaacaaaagaacatattattttgaccaggggtttattaaaaataaaaataaaaacaagtccaatgactcccttttctgaaaccactgaaacacaactattttgactcaaaactgataaaaagatgtaatcatatattcacaaacagtattcacttaggaaattttaccttattttcagcattgatacctataaagttttgtgcttcacctatgaatgtatatatatgtacatatacgtccatataaatattttatttgcttaccattatatttgtttactaaatttggatatacttctttattaaataatttagacaatgaaaataaaattaatgtatactcactgttaaaagcttagaaaatttagaaaaagagagagcagaaaataaaaaccactgataatcttactcagagatatccactgttagactttttgcatatgtcctttcagattttttttgcatgtatgtgtattcaaaaatgggctaatatcttactttattatctgctgctttcatttagtaacaaattatggctatatttctgtggtaatatatatagatacaatgtcattttaaattaggtgtttaacattttatcatcaggaattagtgtaatttcttttttaaattttctattaatggtcatttgatttgattctattttttaaacaaccataaacaatgctgaaatgaatatctttatatgtgcattttttgctcctgttcaattgcttccttaggatatattcctatatgtgatatttaattataaaatatttaatttcctaactccctggaagtttacacttcagtatcaaaaacactagtggatgacaattcctttgctattagaacagaagaccatagaatcaaccaataacagatacaaagtttttctcatgggtaagtgccctacactggtcacttaattcttcattatattttgggcaaataaatttgtatctaaaaaccatctttatgatgatctatgacttataaaaatctactatttatcttacaaattacttccaattacttttacttcttcttctgttgccggtatgaggtcactaatggtagattttagaaaatgcgctaacaattatatgtaaaccatacaattagtattttttaagtgtctacaaagaagacatttgcaagtggtttctagctttattgtgaatgtgcaaggggtatattctatcaagtaagcatcattcctatcctcaagacacttatatatactggaaatatgaaatcattatccatagtttggaaaaatttttcttttaagaaaataatagatggaaaagaaaagagaagtccaaggaaaaaaaaagtcatctgttaagatctgctatgtaccaggaatatagttaactacttccttattaattacagcctcccaataatattgaagtagatattatttattatagctgttttccatatgaagaagtgaaattcagactgatgaaatgatttgcacaaggtgacactgccaataattgatatagtgagattcaaacctaggtgacatacttttgacccaacaaaataagttttcaacaacttgagtgtctcagtgatagaatatattatctctggaagcagtgagcttatcatcatgggaagtatgttagcagatgttagttgatgttggttgatcatatatcagagacatgaaaaatattctactactaatgggcgatttcacttgctcatctccctaggccccttctggagggttagatattttgttgaattgaaaactgtaccatttttaaaccattgatacgtcataagcaaatattagaccacagaataatactcaactattttacacttaagggaaaccaaatatcacaatgaatattatctctaattttagaatactagagaatctcagcggtatttgaaagatcaaaatttatattatgcatgttatttttgcttttaaacactagttagaatgtatggtgctaaatacattttagcgtctgtggtgctaagaacacaatcgtttgattaaacaagatctcttgataaagattagttagcacatgctagcctaacaattactgaaattcacatttttacatgggtatcctattattaagtgattccttagatttaatctatctgaaaaaagtcagtaaaatgttatataaaataataataaaaataaatcctctcttgatttagataaaatagcatgcttgtgtgctaatgtattctactacctaccttccccagttgcttctattaaaaatagtactgtaaaaagaaataaaaatcaaaaatataatatgcctgttgcaaagcgtttcagagaagcttttatgtgaaatttaacagttcatggaacaaagaatatgactggaggcaaggaaaatttctcctctgaaaataagtgaaacctaggtcgtcattagagtttgtgcattcacttttgggacataggatatgttcagggctatgactcatttacatacatgactatgtggcctgtgttttgggagggctgtggggtgttagctgaagccttccatgctggtagttatgctttgctaagagaaggctggttctctacttacaccccctcagatggctctctttagtgcatgtctgtatgatttgacctaacagaaagaagaaatggactagcttctgttattctatgtcagcagcatattttattgaaaggagtatggacttcaggaaaagaaaaatcagggtttgaagcagctgagaagtcaacaagctacttattcttctgagctcttcttcatctataaaatgggcataataatacttcactgagtgagttgttttgagaattgaatacaaaaaatgttgacagtagtaaactgcacatcatctgatacacagttaagaatggagtacattttagcatccttttttttagttctgtaataaggagattgtaaatacatttaaaaaaaaatgtttccctagagtttggtgggtgatattgccacttaggaggatagctatcagctgcactggtgacaaagtacctcctgatgcagacccagagctacataagcaaacatgaggggcttggaagcaacccagacatcaagcaggagcagtttccagggctgtgaagatgtttgctctcctctacttagaaagaggctcttttaggagaaagggacatatttaggagaaagagctctgcctgttcttgcagacccagggaaagaggagcttggatcaggaagccagagagcatttactctgccttagtgagttcctaaggtcctagaaactctctatgggtgggtctctgctgcggtgagggactctgaactgtgacctgcccctcagatcccaggaagaagagaagcaaaagcttagaaagcaaggctgtaggataagtgttagccactgatttcagagctatgtattttccagcaaattgtctaagaactatgctttatctatccaatatagacaatgtactctataataaaattccttaggaattaattttaatagctttcatttataattaaaatctagatggcatttatatattgacaaatgaatacaatttaaccttaagtataagaagaaaatgccagccttaaaaatacattttaactacttaactatttttatacgaatgcacttgagattaatctaatatagtccatatatcttgcagtcagttcaatgtaacaagattattaaaactggtttagaaataggagggtgtttatgagattatctgtcacccttgtattgtgaagcctgagcgcttgattactctgcatgtttgctcttgtgtaatgacaagcacgtcccgtggagccaattactgcctccactttacttaagtgatcctccatcccatcaagaagatattcaacctgattcttagaaaagtgtgagtatttgaagtagttccagtgaaggtggtaaatttcctaacttgaaagcactttcttatgattgcaatgacaatggttaaagaaataaaacttcagaaaagattccacatgaaagcaacttagaatatgagtaattataccttaactacaatcctcagtgatcaaaagataagcaaggtttcccaagcatctttctgtggagcatgcactctaatgagaaagagaagccatgcatactctgataaaaaggcaagaaaattatatttatgaattaccagctatgtttcaggctataaagttgagaattcccaacctgaaaatctgaaatccgaaatgctcccaaatctaattttttgaacacctacatgacaccacaagtagaaaattttgactgtattttgacaagccacagtcaaaatacagtcaaaattttgttttgtgcacaaaattattaaaaatattgtataaaattacattcatgctttgtatagaaggtgtatataaataacaaatgaatttcatgtttagatttgggtcccaactacaagatgtttcattatatatatgcaaacattccaaatccaaaaataattgaaatctgaaacacttccggtcacaagcatttcagataagggatacctaaactgtagtagtacagtgtataatttaatcttgctacagtcttatagggtggttattaaaaatctgagtttctaggtgaggaagttgacatcagggaggtcagaaattgcaaaactgggacttgagaccaggtccatctaacttcaaaacctgttatctgaaaggattctaaaaatgcaaacctgagagtgcatgatgatgtagaatatattatcacatcacatatccagctttgctgaagaacagggtgttctgcacaatatgaggcattgaatataattgaatcctacaccaatactgatttgtttggcatttgagtctgatttcaagtgggaaaacagaagtgttgtttgtaaaacttatgaattaataagttctgagaatcaaaaggactgacctcaaacaaattcaggaaattatatttactcttatttctgtcttagtcctggacagttgacgttgctagataagtttcaaactactacacaattgctgagaaaattggggtggtaggaaaaagaggaaactgatttctattagtaaaactagttgatgacccatagagactgctcaaactttgagtgggttcatatttataggaataaagatgagagacctccaaatcttttcctgatccaataaatattttgtttataaaatatctgacattagaaatgtgtaggggtggggacaacaaaaaaaatgctgagacaaaataggcaagagaatccaaatgtaatgttgacctttgatccttcatctccattgcttaagattttattctcccaattgtcttaagaggtcttaagcaacaaacataagtgttcaaaaaactacagagctctgttagagctaggcatagcacttgacttagtatcctcccaaagcaaaattttgcagatagacaacacatactacataaaacggtgtttcctcttgctcattttaaatttacctcccattaatttcattgcctgtcccttcccaattgtcaagcaaaagcagtatgatcagatttcatcaaaataacttagaccacttaaatcaatgtgtattagacttttcttctttctgtgccagggtactctggaattttatgctctcttttagtaactgctcttctctggtaccaattgactggtgcatttatcatgacctgtattccaactgacacaccacaacaattcctgggaatacagtgaatttaacattaagattgtaagatcagctgacattctaagattcttacagacagggcttacgtgtatttattttggtatgaccacagcagcaaacacaatgtctgcatcacaataggacaaggtgagagctaaaatttaatatgtatctgcatatgttagacttttatgtatatgccatcgtgcatctctacactcatcctctattagtattctcatttctgtcaatggggaaactgagtaagtcacctaagatcaagcagctggtaaataacagagccaagatttgaattcatgtctgtctgactttttttttttttaccatgtgatttaccaaccacactcagtacccaaaatattacttgtggaatgccattttcacagggttgtttatcacacctctaattaaacctacccttgagagggaaaaaactgcaactcagcaaaactgtaattcacaactagcctaatggccaagtggaatggtacatgccatggtcaatcacttagcacgtaagtagtgtgtgatgaagaggtaaaaattgaggcacacacagagccagcctctgttaataacaatgattctttggggactgagtctccactttcattttaactaccactgtagaaaaatgataaataaagtcagtaggtaggatggcaatatgataggtagaaagagaagaaaaaataatttgtgtatttgtttaccactaaaatgcccttaagaggcagctttgtccaagtggcacttttaacatttatttttacttttaataatcatgtgtattatatttttatggctcaatggcactatatgtttgaagaattttagaacattaatatccaatgttacctaagtctagctgtggacttcatgcatgaaacaccattccagcacagaagcactcctagcttgaatatcctcagtattgaggaacttactatcacacggggcagccactctatctttgaataaagatagaatgagtaaagttgataagaaaagaaattcttaccttcacatcaatcaaagatctgtattcttacaatatccctgaaattattctgtaagcaggcctgaaagaattacgtggcaacatatgttgctaggctggttcgttgggttttggcaaagtcctcagtgtttgtcagcatttctatgtgagagaactggctacatagtctatcttggagctaatatcatacttgggtcactaaacatatgtatgaaattttgagaattgtttcttaatttttcagttttaaaatctaatgcaaacctgtatttcagaaaaaaagtattgcttgacctttttaaaaattatcacttaattaacatggggcccagccgagttagaataacttctcacttgttccaacataagagaaacaagcaaggtactcctaccagggtgtcacttagacctgcatattctttttagtgattgcaatgttacttcttagccacccaggccaatccaccataaaacaatcattctccaactttcctggtcttaagagtcacttggattgcttgtttaaaaggcatatttgttgagctctgcctccagaaatactgatttagtagcatggagccgaggaatcttcatttttcaccagcgctggaagtgattctgatgcaagtgatttgtagaccacattttgagaaaaattccctaatgttagcagttgtaatgatgcaggtagttcattcagttttgcttcagtacaaaactgcaaggataatactattgggttttctagatataggatcatgccatctgcaaacagggatagtttgacttcctctcttcctatttggatgctgtttttcacactgctgtaaagatactacctgagactgggttatttataaagaaaagaggtttaactgactcgcagtttcgcatggctgaggaggcctcaggaaacttacaatcatggtggaaggcaaaggggaagcaaggcacatcttacatggcagcaggagagagacacagtaaagggggaattgccacactctaagaccatcaggtctcgtgagaactcacccactatcatgaaaacagcatgctgggaaccaaccccatgatccaatcacctcccactaggtccctcccttgacatatcaggattacaattcaagatgagatttgggtgggaacacagccaaaccatagcagatgccctttctttctttctcttgcctgactgcactggccagaacttctgatactatgttgaataggaataaggagggcatgcttgtcttgtgctgattttcaaggagaatgcttccagctttgaccattaaaaagaatgagattatatcctttgcagggacatggatggagctggagaccattatccttagcaaactaacacaggaacagaaaaccaaattctgcatgttctcacttataagtgggagctaaatgacgagaacacatggacacacagaggggaacaacacacgctgatatcttttggaggatggagggtgggaggagggagagagtcaggaaaaataatgggtactaggcttaatacctgggtgatgaaataatctggacaacaaacctccatgatacaagtttacctatgcagcaaacatacttgtatccctgaacataaaataaaagttaaaaaagaagaaaattgcaaggatggtaagatttggggctctttcataacttttcaaatatgtcaactgagaatatcaaaatgaatcaccagccttttttgtttggggtgtgttcctgtgtgtttgtcacaaaattcacatacttttcaactgtgcctgccttacactaaaatagtcattatacccagctgtataggcccagctatatacatatatatgtatatatatgtgtgtgtatgtgtttgtgtgtgtctgggggctccacacacatttggtgtcaatactgaagtaatgcaaatatctctgtattggctacaaaactcaaacaagaaaaatgaatagatttggatctgatatggccttccactttggctctgaactttagttgtaaggaagaaaataatacttagtaagagtaatatataaaatagtgattgtaaaaccaactatttgtgaaatagtctgccaagtattatgggatacataaagatgattaacacacagttcttgcaaaattggagcccacaacttagcagaagttgttaatcactttggtcaggtgaatgtttcactgaataagaaatattagtgtattaagtcatcagattctttaatgctttgaagtgcttcatactgagctctacataaaatagaaacttcgtgtgtgtgcatgtgtgtctatatatatacatatttgaagacagggtctcactatcttgccaaggctggtctcaaacacctaggctctagcaatcctttggcctcagcctcccgagtacctgggactacaggcacatgcctagcacatagaaaaacttcactggtgtccaaggtggctgaataggaagagctctggtctgcagttcccagtgagatcgatgcagaagatgggtgatttctgcatttccaactgaggtacctggttcatctcattgagactggttggacagtgggtgcagcccacagagggcgagctgaagcagggcggggtgttgcctcacccaggaagtgcaaggggttgggggatttccccttcctagccaagggaaactgtgacagactgtacctggagaaatggtacactcctgatcaaatactgcacttttcccacagtcttagcaactggcagaccaggagataccttcccttgcctggcttggtgggtcccacacccacggatccttgctcactgctagtgcagcagtctgagatcaacatgcaatgctgcagcttgacggggggaggggcatccgtcactgttgaggcttgagtagctcacagtgtgaacaaagcagccgggaagctccaaatgggtggagcccactgcagcttagcaaggcctactgcctctctagattccacctctgggggaagggcatagcagaacaaaaggcagcagacagtttctgcagatttaaatgtccctgtctgacagctcggaagaaagcagtggttctctcagcacagcgtttgagctccaagaacagacagactgcctcctcaagcaggtccctgacccctgtgtagcctgactgggagacatctcccagtaggggccaacagacacctcaaagaggtgggtgctcctctgggacaaagcttccagaggaaggatcaggcagcaatatttgctgttctgcagcctctactagtgatacccaggcaaacagggtctggagtgggcctccagcaaactccagcagacctgcagctgaggggcttgactgttagaaggaaaactaataaacagaaaggaatagcatctacagcaacgaaaaggacatccacaccaaaaccccatctgtataggtcaccaacatcaaagaccaaaggtagataaaaccaaaaaaatgggagaaaccactgcagaaaagctgaaaattccaaaaaccagaatgcctcttctcctccaaaggattgcagctcctcgccagcaagtgaacaaaactagacagagaatgagtttgatgagttgacagaagtagccttcagaaggttggaataacaaactcctctgagctaaaggatcatattctaacccatctcaaggaagctaaaaaccctgaaaaaaggttagacaaatggctaactagaataaacggtgtaaagaagactttaaatgacctgatggaactgaaaaccaaagcacaagaacctcatgatgcatgcacaagcatcaatagctgatttgatcaagtggaagaaaggataacagtgatggaagatcaaataaatgaaataaagcaagaagacaagattagagaaaaaagagtgaaaagaaatgaacaaagcctccaagaaatatgggactatgtgaaaagaccaaatatacatttgattggtgtaccagaaagtgacagggagaatgaaccaagttagaaaacactcttcaggatattatctaggagaacttcccgaatctagcaaggcaggccaacattcaaattcaggaaatacagagaacaccacaaagatactcctcaagaagagcaaccccaagacacataatcatcagattcaacaaggttgaaatgaaggaaaaaatgttaagggcagccagagagaaaggttgggttacccacaaagggaagcccattagactaacagtggatctcttggcagaaacattacaagcaagaagagagtgggggccgatattcaacattcttaaagaaaagaattttcaacccagaatctcatatccagccaaattatgcttcataaatgaaggagaaataaaatcctttacagacaagcaaatgctgagagattttgtcaccaccaggcctaccttacaagagctcctgaagaaagcactaaacatggaaaggaacaaccggtaccagccactgcaaaaacatgccaaattgtaaagaccatcaacgctatgaggaaactgtggaattaacaggcaaaataaccagctaacataatgatagggtcaaattcaaagataacaatattaaccttaaatgtaaataggctaaatgtccctattaaaagacacagactggaaaattggataaagagccaagacccatcagtgtgctgtattcaggagacacatctcacatgcagagacacacataggctcaaaataaagggatggaggaagatctaccaagcaaatggaaaacaaaaaaaagcacggattgcaatcctagtctctgataaaacagattttaaaccaacaagatcaaaagagacaaagaaggccactatataatggtaaacggatcaattcaacaagaagagctaactatcctaaatatataggcacccaatacaggagtaaccagaatcataaagcaagtccttagagaccgacaaagagacatagactcccatacaataataatgatagactttaacaccccactgccaatattagacagatcaataagagagaaagttaacaaggatatccaggacttgaactcagctctggaccaagcggacataatagacatctacagaactgcataccccaaatcttctcagcaccacatcccacttattctaaaattgaccacatagttagaagtaaaacactcctcagcaaatgtaaaagagcagaaatcataacaaaccgtctctaaaaccacagtgcaatcaaattagaactcaggattaagaaattcactcaaaactgctcaactacgtggaaactgaacaacctgctcctgagtgactactgggtaaataacaaaatgaaggcagaaataaagatgttctttgaaaccaatgagaacaaagacacattgtaccagaatctctgggatacatttaaagcagcgtgtagagggaaacttatagcactaaatgcccacaagagaaagcaggaaagatctaaaattgacacgctaacatcacaattaaaagaactagagaaacaagagcaaacaaattcaaaagctagcagaagacaagaaataattaagatcagagcagaattgaaggagatagagacacaaaaaatccttcacaaaatcaatgaatccaggagctggttttttgaaaagatcaacaaaattgatataccactagcaagactaataaagaagaaaagagagaagaatcaaacagatgcaataaaaaatgataaaggggatatcaccaccaatcccacagaaatacaaactaccatcagagaatactataaacacctctacgcaaatgaagtagaaaatctagaagaaatgggtaaattcctggacacatacaccttcccaagactaaaccaggaagaagttgaatctctgaatagaccaataacaggttctgaaattgaggcaataataaatagcctaccaactaaaaaaagtccaggacaagacaaattcacagccgagttctaccagaggtacaaagaggaactggtaccattccttctgaaacttttccaatcaatagaaaaagagggaatcctccctaactcattttatgaggccagcatcatcttgataccaaagcctggcagagacacaacaacaaaagagaattttatgccaatatccctgatgaacattgatgtgaaaatcctcagtaaaatactagcaaactgaatccagcagcacatcaagaagcttatccaccacgatcagattggcttcatccctgggaggccaggttggttcaacatacacaaatcaataaatgtaatccatcacataaacagaaccaacaacaaaaaggacatgattatctcagtagatgcagaaaaggcctttgacaaaattcaacagcccttcatgctaaaaactctcaataaactaggtattgatggaatgtatctcaaaataataagagctatttatgacaaacccacagccaatatcatactgaacgggcaaaaactggaagcattccctttgaaaaccggcgaaagacagggatgccctctctcaccactcctattcaaaatagtgttggaagttctggccagagcaatcaggcaagagaatgacataaatcaattagaaaaagaggaagtcaaattgtctctgtttgcagatgatatgattgtatatttagaaaacccaatcattttagcccaaaatctccttaagctgataagcaacttcagcaaaatctcaggatacaaaatcaatctgcaaaaatcacaagcattcctatacaccaataatagacaaacagaaagtcaaaacatgagtgaactcccattcacaattactacaaagagaataaaatacctaggaatccaatttacaagggatgtgaaggacctctttaaccagaactacaaaccactgctcaatgaaataaaagaggacacaaacaaatggaagaacattccatgctcatggataagaagaatcaatatcgtgaaaatggccacaccacccaaggtaatttatagattcaatgctatccccatcaagttgccactgactttcttcacagaattggaaaaactactttacaattcatatggaaccaaaaaagagcctgtggagccaagacaatcctaagcaaaaagaacaaaccaggaggcatcatgctatctgacttcaaattattctacaaggctacagtaaacaaaacagcatgattctggtaccaaaacagatatatagaccaatggaacagaacagaggcctcagatataacaacacacatctacaaccatctgatcttcaacaaacctgacaaaaacaagcaatggggaaaggattccctatttaataaatggtgctgggaaaactggctagccatatgtagaaagctgaaactggatcccttcctcacaccatatacaaaaattaactcaagatggcttaatgactttaatgtaagacctaacaccataaaaatcctagaagaaaacctaggcaataccattcaggacataggcatgggcaaagacttcatgactaaaacaccaaaagcaatggcaacaaaagccagaatagacaaatgggatctaattaaactaaagagattccacacagcaaaagaaaaggcaacctacagaatgcgagaaaatttttgcaatctacccatctgacaaagggttaatatccaaaatctacaaagaacttaaacaaatttacaagagaaaaacaaataatcccatcaaaaagtgggcaaaggttatgaacagacacttctcaaaagaagacatctatctagccaacagacacatgaaaaaatgctcatcctcactggtcatcagagaaatgcaaatcaaaaccacagtgagataccatctcaagccagttagaatggcgatcattaaaaagtcaggaaacaacagatgctggagaggacgtggagaaataggaatgcttttacactgtttgtgggagcataaattagttcaaccattgtggaagacagtgtggcgattcctcaaggatctagaactagaaataccatttgacccagccatcccattactgggtatatacctaaaggatcataaatcatgttactatgaagacacatgcacacgtatgtttattgtggcactattcacaatagcaaagacttggaaccaacccaaatgtccaccagtgatagactggattaagaaaatgtggcacatatacaccatggaatactatgcagccattaaaaggatgagctcatgtcctttgcagggacatggatgaagcaggaaaccatcattctcagcaaactgtcacaaggacagaaaaccaaacaccacatgttctcactcataagtgaacaatgagaacacatggacacagggtggggaacatcacatgcaagggcctcttgcggggtggggagctgggggagggatagcattaggagaaatacctaatgtaaatgacgagttgatgggtgcagcaaaccaacatggcacatgtatacctatgtaacaaacctgcacattgtgcacatgtaccctagcacttaaagtataataataaaaaaaagacttacaaccaacagagagtttgaaatatatttaaattaaaagtattattaaaaaattctaaaaaaaaaaaagaaaaacttcactggcatagtaaaatagcacatgggaaaaaatcctctcaatttgctaagtcaatattcttataactgatgttgcttatatgtcattgttgttagatctgagagtggaaggaaataatttgtagttattgttataatgaaaaaaatgcaattatctaaagattcctatcattttctcactactccttaagcacatttattcattataatgtagaggaaggttgccttacttgtggtctcaccattcatctctttaagttcgttgttgattccaacatctatggaactcattattttgtcaatctgtaagaaacaaaaaccatttaaatggattgttacattcacttttaacattgtattttaaaataagtttcaaatgaagggagcaaatatttttgatgttattaccacagtgttccacagttaagagatgcatagcgaaatatttaaaggaaagcaaacatctttcggattgttttattaaaatgtaaagtatgttcccctttcttaaactttcaaaattagtttgccttttctttgtgtttcttgaaataaactttgtacttggatagattggtcatttaggaactgtgtattcttcaaactcagaaggactgtagataaattcatgtgacaaagtctctgctctctggcacccttcttcttctgcctaagaacatgcatcccatctaactggtaaaggagcaggtttcagggtgtggagagcacggccacaggagcaaagttttctgttttttgtttcgacagaatctcactgtgttgcccaggctacagtgctgtggcaccatctcagctcactgcaacctccgccgcccaggtccaaatgagtctcgtgcctcagcctcccaagtagctgggattacaggcatatgccaccacacctggctaatttttgtgtttttagtagagatgtgattttgccatgttggccaggatgtttctgaactcctggcctcaagtgatctacctgcctcggcgtcccaaagtgctaggattacaggcatgagccaccattcccggcctggagcaagttctaaccaaatggtttgaccaaccacaagctgattactgacatccaatcaccagcatctagtcatgaaaacaacttaattataagatctaagttaaatgttaattaatcctgcctctacaaaaggatctcagatgttattcactaaattaataaatataagaaatggctatacttgaaaaactaaccatctactagtatggaatttaaaggaagatatgatggtctaagctatagcaatttatggcttaatgactctcttgatgttagcaacctgaataagatagcaggtttcagaaaggacaatgggcattacttaaatgtcccagtttgttcaccctgaaacagatgcagagatattaagtgattttcccaaacagctcagttcagaatatcactatcagaccatatccatttctagttctccaaatactataatgatctattgtgcttctaaacctaatccaactggtacagtcttttcagagacaatatgtgatgtgttagaatgaaataccaagagagactgtatgaaattaaacactttaagtagaactgaaattggtgatatttgaacctcaaacatttttttctttatttccctgatagctgcaaaagggaaatatcaaatgatgtgtgtttattgtatggtggctggagaagagctaggaaactttatttactatgaagattctaaggagctcttctgaaaatataagatactttaaagaagggagacaaactaacaaagagtttggcaagtagcaaaacaacacagagcaaaatactgagctttttctcgatttgtcagctgcagtgcttggtaggacgagatgtgaatattctcttgtacctcatagctagttattacttctgcttgatatcaatttctatggaaacaatagattaacccacatgtgtggaacagtgtttgtttttatacttgctgtgaaattaccatgcattacccacagaaccatttcattccagttggagccgtatgcttttttttttcttgcttttgaaagagctaaaaagctgaaaatccttcccccaaacctccctcaactgcaaagccttataggatgaacagcaagaagaacaaagcttacttcttcccattccgatgtgaaggatggtgttctttcagaattccctttagaactgtgttcagcagtggaagattcactccagttaactcttgatgttttctcattggaaggataggcaatgagatcagaatcagatttagagacactttttgacaaatgcatgtcgatcaaggctttaggcaatgaccttattctccccagagtacaggctctctccacaaatccccctgcgttcataacccactggtccccattccgagatccactcctggttgatcttgtgccaacaatggtatggttttcgagttggttgctttttttgtgaaaaattgttctactgaccactttgggtttaattttctttaccaaaggttctgagttattttctattggagactgcttgaaaggcaaaggactgtttgccaaactgacttcatcttgtcctttttcacattgttctcttttcccatagagatgaaatggattttcaggggactcacaggctggagaggatccatggagcaggcctgcaaattgcccaggatcatattcttttgggggatcattgtcatcctgtcgggagaggtcatctgcaaaaggaaggaagggatatcagggtttataaaggttctgaaagccacgatataatagcagtgcccttatgaacatgtgggctatccaaacatttcatttactgctacatagcaataccttcactttatgaaatacccctgaccccacagtgccatgtatagaatgaatgtatgagtgtgtgtgcgtgtgtatgcatgtgtgaatcattctttctgatataccttagagttcatttcaaaagtatgaattgtgtattaattgaatgacttcattcacttctcccttgaacccagggtgtatgttttatagccaatgaacaaaattgggttttcttaaagtagaacacacacatctaaactctcacagtaaatgaatcatcgtgaagtagaacactaggcaggtaagtcaaggtcatatataatgacaaccctctgccctcctcccagcaaataaattcaaaaaccaaattttgaaaaaaggtattattaaaagtaattgaagtttaataatcctgatattaccttaaatataaatttaaaataattctatgcagattacataatttagacaaaaaaaatttgttcagacttaacaaaggcaaacaacgcagtatcagaaaaagagagactccaatataagaaactaatgtttagctatgaacacaaaggtagctttttctttcttctctgaaacggcattagctattttctaatttcttcagatctttgaagatgtaatgcagaaaagaaaccaatgatgaatgataatttttattcctttggatttttttctaagataaaacacacattttctctgagatttaaaatacaccatgctttttgcgacttaatttgtctttcaaagacatactgtgtaaaaacctggccaaagaatttagcaaagaaaggaagtgtcctttttttcagtgttcattttaattcatatcaatagctaaatattgccaagatgaaaatttaaattacctgataagcccataactcactgttgcaaagaactaaagtatagtaaatgtggtacataatgacaacaaatccaaagttgatgtgctgattcgtactttcagtaagttaattattaccataaaccccaaacactaacatttttataaattaacaagtaacatttaatgggtaagtgttatttactaggcactgaatgaggaattatatcatctcatttgacacccataacaatcctatgaagtgattattaataataattatgattttgtgatggaacgagatggccaaaatatcgaattctcacatttttaagaaattggcaaccataataaatcttattagacattggctcagaagatgctacaggcacatctgctctttatagtgaagattggccccaggtgtctatactgctctccgcctgggaactggtgaaagcaggtatattcctagctatgtatctctagacttcaccctggttcctgcttgatttttccaaagagaagatgtttgcctgcccagctatcataccagcatcctgagattgaagaaagaagagtgacaggaagagagatccaagacacatgaatctacaaatgcaacaatctgcatccatctactactattatactcactgtcttctcacaaaaacaaaacagaacgataaaacctcatcactttctaaaatagccacactgtcttgataactctctattttattttcctttcacaacagagaccattctaggggtagaatagtgagtggatagtgggataaggcagctttcaattctctccaaagactagagtttatcactgagtatgtgcatttttaagaagtcaaaactaacacttagacaacttaagacacagacatttccccacctagtaagcaattaagctgagattcaaattaaggtctatcagattctgacatccattggccttgcaaatatattgctattaaagataagctttaaaaaaatctagggttggtttatccataggacaagcaagtaggctctttgtaaagagacatgcttctcctgttcatgactgtatctggaatttgggaaaagtggactaaaagcatcagagctttttctttgttttgttttgttttcttcttggagataagctaatactaagaagaaaataagacctggcatcttgttccaatgcattttttttcttaggctacttggatctcacagagtgctttacaacataagcaggttggtatgggtgacaataatggggattaaggtggtaggaaggaggaattctgaaataaggaagttttagaatttcattttgaaagttgctgaagaaggataaaaggtctgaatttgaaaggaaaattgaaaagagcttgcctattgtgggaaaaagattctgtaaatctcagccaaaagagtttccgacgatgttcattatctagaaaaatgagaattttaggggcgtaatattatttaaagttttctgcaaatattattattaggttaccatcccctctgtagtttgactacaatgactataattaccaccccacaatgctttacactgtccaagtcctccaatcacaagcagtcacttctcaaagtaaaagataatttcattgttagcttataaagcttagttttttgaatagcagttcttagcattgtgatggtaacatttctgccaagagtggtgaaaagacaaatattacttgctttttccagtggccaaatcctaaagattattcaagtcaaagaaaaggagaagttgatatgaagcctcctggaaagcctgtgtggtggattgattgcagttatggccccagtctgctcacagctccctgcagacacagccctccccgtatctagtcctctcacgctgactccctcacagcgtggccatgtgccttgtaccgctcaatcagactgcagcaaatgtgatataagcagagacctctgaaaagcatgtgtgcattagacttgttcccttgttgctcttggaaccctgacaccatgtgaacaagccaggctggcctgctggatgatgaggtgacacattacccagctgtttcaaaatgtaggttttattatatttttcaggtatgttgaaaccaacagatcaggagacaattgccattgaaagatagacgctctactcattgatccgagaggcatgccacattataggggccacacagggaactaccagggtccatcaggaggaggctgacaaagtgaggggagattgtgggcaagagcctttactatggtttccatgaaaagaaacacacaaagcaggtataagcaggtttaggaatggctagtttgaatagtttcagcagactctggggcataagaactgtacctagttgtctggtcattagagcaggtgaatgaatagtggcctagagagtgagagccagatgaaggaggtaattgggactatgggctctacgattgttagtttgcataagaaaagcatgctctctggtgagctgtttactatctctaggaattagctagccccaggaggggccgtccctccacagcaagagctcaagagaccaaagcataaaaataaaaatacacaaataaaatagaaaataaaaagacatggttaatacatccgccagtcctgtcaccccaaccaaaagccagccaacttccacctatgtgagtgagggcatctaggacctaccaaattcaggccattctgccaataccaccgatgcatcagcaagcacagctaagaggagctgaggttttcccaggccagaagaagacacccaccaggatcatgagcaatattaatggccattaagtttgggagggtttgatatatgaaaatataaactatatcccaagttttaaagaattaatatattcttcaaaataaattctggcaatgtttatatttccacatctggaaaatgatgatagtaatagaacatacctaaaagtgctgtgaagattgaatgaaatcatagaataataaatgtgttagtccatttgggctgatataacaaaatttcataaaccaggtagcttacaaacaacagatatttatttctcacaggcctagaggctgagtagtccaagatcaagacacctgcagatttggtgtcaggagagggttaattttctggttcatagagggcaccatcttgcctgggtcctcacatggtggagggagcaaaggagctctctggagtctctcttataaggtctctgtcctcatgacttaatcacctaccaaaaggcccacctcctattaccatcactttgggggctgggatttcaacatatgaattttggtagaacacaaatatttggaccatggcaagaagtaaaacagttagaacaatatatgctgcatagaacactaagaatatgtttctactattataacaataatttttaatctatagggtttcatttttataaagaaatacagtaataactgtattagacactcaataaagattattttgacataataatcatgtgggatttactcctttgtttctgtttgtatattttaaaaagtatactttggaaagaattttttgtgttttcttaccctttcttcagacaaaacggaggaaaatatacagattaaactgttgtcataacttgtctcatttaattttacacttctcttttgataagtggatatttcatgccaaggtacagaactaaatatgtgtgaattccaatctgatagttattcaaggcatcattagcatttcaaagaaatgtcagagtaaatgtccaataggaagcagttcaatctctttttatccacctttgctatgatttttatcacctatatatcacctgattaacaataaaatccaaaatttcatgctatggaaaaattatagaaaacaagttacttttttctattatagagtataacttttgtctattgggtcattgcatctgatttagaaaataaaaatttttcctatttttaaggataccggggctgatgttgatattagtagaaactgtgaatttatttcacaaatatgtataaaacgtttcctgtatatcaggtggcaaagtttcagcagtgtcaaaggcaatgtcctgccttcatggtgcctacattccagcagaaaagatgactacaggcaaatcaagaaatgctataatttctgatgatggtatgtgctgtgaaaaaaataaagcaaagtaatgagatagaaacgaaaggaagatgctataaggcaattaggaaatgtctttctcaggagctgacattgagcagacatagaaatgactgtgaaagtgtaaatcattcaatgttttgggggaggattatttcaaggcataggaaagaagatatgaaaagtccctaaggctggtaagaacagtaagaaggccagtgtggctataatagagtggtaggggattagtagaatggctgacgattgaatcagagatgcaggtaggaatagggttggggtgatatgacttatacttttagaagataattggtatttctgaacatgacaacagcatagtgttctttttaaattattcacctcaattctcataaaaacaagacacggggatagtaaaagaataaaatgagcacatgatagcaaaataaaggaaaaacactacaggtgatatctccagtaaagctaagtattaagaagtccccatggccccgaaacacagaggggtgtagccaaatcacatgacagcagtaggatccggaactgaatcagcagtgatgcagctatagtggtgaagagaaagggaaattcaatggcacctacaagccatggaacccagaaattgccatcagatactgatttcccaaaggagagggtcttgtgctaagcaggagtgtgcagtaaaatttgagaacaactagcagaacttgtacacatcttgtaacaagaccacaggaagtagcttactcccttgagaatatcagaaatctccaataaatgcatacttgtagtaggctacagatccactctgaagaaaaacttctgggagaagaatacaaattgcacagggtgaaaacaccaaagatgtgagggagaaaaacatttcatataatggggcagtaggggccaggtgcagtggctcacacctgtaaccccaacagtttgggaggccaaggcgagaggatcacttaagcccaggagtttgagaccagcctgggcaacatagcaagacctcatctgtacaaaaagtgtttaaaagaaatttaagcatgataatgagtgcctgtgagttccagctactcaggagactgagatgggaggattgcttgagcccaggagttcaagtctgcggtgagctttgatcatgccactgcacttagtctgggcaacagagtgagaccttctctagaaaaaaaaaaaaggcagtgggggtggcatcaggcagatgtccagtagagggagactttgaatgtaatagaatagcaaagcacagtgttcagatgtgagagcaccactttggaaggcaggcgcatggaactcaagaacactgaggtagtagcaggaagccttcctgaatcaagcagagaaaaacctgtatttcttaatacttcatcgtaactgcaaaggagaaggcccttgagatgtgaagggctcatggctactgtggctcatccctgctcccatacaggaatctcttcctaatccatgacatcccttctcattaaacgtgggaaacaaaaaaggatttagatagagggcaattttaggaataaaataaataatgacagtaatggattataacccactgaataaaacagaaagacacgagcccataaataaacaaatgatttaaaagtttgactaggaatgggaatcctaaataatttcaaattgcctccccacaaaatacttattaattagaaagaggaaaaagagacacgctacagtgaagaaatctgggaggccctatcttaatcaaatgatcaaagtgaacaatatcagtaatggaacaaatcaaaatcatatccagtgtggtaaagatgcaatgagaaaaatgcagaatcacttttggattttcctgccaaagatgtacaacctaaatctaattatataggaatatcagaaatatcagagaaatccaatttgtgggccattctacaaaataattggcctgtaatcttcagaagtgtcaaggtcatgaaagtcaaagaaagtcaaatgaacccttccaggctgaagaaaactaaggagacattacaactaaatgcaacgtgtgatcctgaactagatcctttgatcataaacaatattattgggtaaaccagcacatcttgaaggaggtctgaggaatagatgctagtgatgtattaactttctgatttggttgcacggtggttctgtggttgtgtaagaatgtacttgcctgtagaacatatacactaaattagtagttatcaaagtgtagtccagggatgcttggggtctccaagattatttcagaagtttcatgaagtcaaaacaattttcagactaacactaagacattatttgcccatttcactttcattatctcatgagtgtacagtagagttgttcagaggctacatgatgtgtcttttcacagtggaaatatgtgatgcctctttctatctcagctgtaggaactggcacgctattacttcttgacagaagaaagtcatatgtctaaacctaaagtaaatggagtgaggatgtaaatggccacctatgctactgcactgcaatgtaccatggcagaagagagagtaaagaactgagaacagtaatctcatcttaaaaataatgtttgctctaagttttgggtagatgccctttattaagttaaatgtcttatcttctaaggttgctgagaattttaattgtgactagatattgagtttataaagaatgtttttctgcatctgttcagttatgtaatttttctcctttactctgttagtgtgaatgacatttgtacattctctaatgttaaacattagatattaatgggataccaacaggataaactcagtgtggtcataatgaactttctttttggcatcctgctagatttggtttgttagtactttgggatctttccatctatgttcatgaaagaaataggcctttggttttaccttttttattctgtctagtttttacatgattactcacctcacagaaatagttggggaaaatttccatttccctagaagagtttatataagattggaacgatatgtttcttgaaagcctttatatttactttacctttaaaatcatctagactcaacatattctttgtggaaagatttcaaattattcattaaatttatttagtatagaactatctggagtctctatacctttttgaagttttttaaagttttaattatctagaatttgtctaatttttctcagtattaaaattcactggtacaaaattattcattcttctttcttaactttgaatggttttttgtatctgtagatttacccccttttctttcctaataggtttatttgtgcctttttatcttgatcattttgactggaaagtgcatccatttttttagtgtcaccaatgattccatttctggctttgtgaattaatattacatatttgttttctatttcattcatttctgtcctttactattttctttctatgccttttctggatttattctattatttcttataaaatttcttaagctggcatttacctcattagtcttcagcgtttcttcttttctaatatatgcatttaaaatttctaagttccactttatgctgcattcatcacatttgatatttagcatttatatttttgtttaactttaaaggtttttaagttagtattatggcatctcctttaactcatttctcatgacttatttagaaacgtgtatttaaattcataaatatatggggatatatatgggaatcttaatttaacttaattgaattatttttagaaaatatagtgtgtatgaatatgagtctttgacatgttgaaacttgcttatagtcaagatcactttttgtgactgtttcatgagaattacatgtattctccaattgttgaatacaaagctctttgcattatgtcagattaaatttattaatggaactcttaaactcttccattgagtgaggtgtgttgaaacctaattttagcagacttatgttttttcctatgaaatatatgtatattatatctggccaacatggtgaaaccctgtctatactaaaaatacaaaaatcaactggctgtggtggtgcgtgcctataatcctagctactcgagaggttgaagcaggagaatcgcttgaaccagggagttggaggttgcagtgtgccgagttcgtgtcactgcactccagcctgggtgacggagtgaaactccatctcaaaaaaaaaaaagaaaaaaaaaagaaaaaagtctaaagttaaataataccttatccacttccttcctaaacaatttaaaaactttagagcattttacattcaattacttcttctataataaatattgttgtcagtgttttaattattttgttagctttacaaatcaggtgttattattttattcagaccatttttaaatttcaattggtttacatgtttgccattttatttactcacaattcgttcctcagaatggcctgagatcattttccttcttaaagttattctttagaatttccttttatacaggtctctggtggtcaatgctctagttttcaactgtgaatatctttctattttactctcatttatttaaaattcataattttaggttgatagttattttctctcacagtttgaagaaattattccacttttttgtggctttcatctttccttgttaattctgctataatgatacctgtctttcttgtgggtgatccatcctttctctccacctggtttgaaaatctctgtatttttcaatttcacaataatgtgtctcactatggatttctgtttatttatcctgcttggaatacagtgtgctttctggacctgtgaatccatatttttatcagtttggaaaaaaatcagccattatccatcaaaaaatgtcctctcctacattttttaaaaaaattatttcatcccggccgggtgcagtggctcatgccgtaatcccagcactttgggaggctgagacgggtggatcacgaggtcaggagatcgagaccatcctggctaacactgtgaaacccggtctctactaaaaatacaaaaaattagcctggcattgtggcgggcgcctgtagtcccagctactccggaggctgaggcaggagaatggcgtgaacccgggaggcggagcttgcagtgagccgagatggtgccactgcactccagccggggcaacacagcgagactccgtctcaaaaaaaaaaaaattatttcatcccgagtctctgattcaaagttaatcttctgattccatacttcatatctcttcataccttccaaattttctgcctctttgcccctctgtgatacattttggggaatttttttcaaatgtatccttcagttcatcaattttctcttcttctgtgcataatctgctatttagcctattcatttaggattttaaaagtaatctcaagtattaaatttttcatatctgaaaatgccatttatttttcaaattttcctactattatagtcaccattttttactcattttaatgataaggcatattatttatttaaatattttgtttatatatagtggttctatttcttgtttcctatttccagtaataatatctatagtcattgagcgctaaatatgtctgtgttatttttgttgatatctacttatagtggtttgcttttcaaggtatttagaaataatttattattaactttattacttgattttaatctatggaagcttgtcaatctcatcagggaaggttttctgcagagagaaaaccttgtgcttccctgagctgtgttgactcagccttccagccttccagctgagccagggaacagtgtcccaaatagcaacactattattcccatctgcactcagaacaacaacagccctcctctcttctatcagatgtttttagagagcaagagtgactggagcaggcaatgtctcaagaacatgtcttattcagaatatatttgttctgctgcagaaagatctctcagagtacctagactgacataatactttgaagcataatatttttatttaaaaatgtacatttgtgacaatttcacttcaaaaaaaccacagtttattaggaatcaaaagtttttaacgtgactctttaaatgatttgtaccctactacataggtagggttaataataaattgccttgctctgcatgtttttgtcttgtaatgtatgatgtaatatataatcaataaattatcctgagaattgtataaacgaagaacaagcttattttaattaattatggcctcaaataaagcaaatccttttaaaataagatccccctaaaaagtatatttataaagaacacaaaagaaactaagggaggtttggtattttgaaagaattccaagtagtctatgatcttcatttaaaaaaaaaagcatgcaaaataatcatagagtgtgttttgtacataaatcctggatcaacttgatttgactaaagatagcaaggagctaaactttaataatatatactgtcaacttgtctcaacaagcttttaaaggagtgctgggttttagaaatattagggagaaatattatccacttgttttttttttttttttttacttataatgtaaacttatgtgatgagctagtacattcatttttttccaaatattgagaaaatattttccagttcactttccaggtcaccttcacattgagatagaagtgtgagtcaaacaagtaacaatgagccacagaggaaactatgtagaactgacattcccttaattccccaatgtaaaaaaatcaattatagtttccaaacatacaagaaattaatttaagcaaactccaattttctggaaaggaatttatttcaaaaattacaaagaccaagattccatactaggtaaggggaaccaccaatagatattgtgtgccttctatgtccaaggtcattctatctcatttaatcctcacaaaagtctctgaagtaggtattatggcatttgcactgatgaagaattagatagctagtgaacagaggagcccgtatgagatataaatctggctaatgcaaagccggcttttttccgatacatcacgacgctttgtgtcggattaccctagaacctcctatggcatcagtacaatgcaccatccactggagtgtcctatccaagtagcactggagcttgaaaaccacccagtgggcctctttccaggtatcagtagtgatctttgggtatttattctgattgcacaattagcccaaagattgctggtatgtttagatgctgaatggtgttagatagagcatgtaataaaattccctcttctaagcaacttaagaccggcagctgcctttctgaaaagccacccaggtaagctctgttgtttcctggtctattagccctacactctgccaaactcagcatttactgcggaagccagagaatgctgacattctgacagctcttggacagcagaccatgctgtttgactctgatttcaaacatttataatcttttctcttgttccctttgctcaatacaggagagaggctatcagccaatttccccaccgtttatagcaaatcccaaggctccctcatttccagctgctaagctgcctgggcagactgtattactaaattattgtatctttttggtagagtgcctgatctgtcttggcatgcgctttgcattgaaagaagctcctgttgcaagcaaaggaagccagcgacattcacccttcccacacgtctttcctctgttaccctcaaccactaacttctttgtttcccatgtataagccaagttcacaggggcagtttctcagctatctctgcctccctagggagttaaggatttcaaagagagttctgtgctaggagtatttcccatagcctagagccagatgaataaatggcgtctagtgaataactacatcagaaccaagaggttttgtttctctcttaccaaaatgtatttctttgtaataccacagtcactgtaaccatgtattttcctcatcagaagagactgtattgggggaagagaggaaatagcctctttaactcaagtcggttgttttcaagagtgttggtcctttggtttaacttattttaataacttcccatttatatactatcccaatggattatgaatgtgaaaaaagaactattctgaagaaataaaacaaaaaaagatctacgatctttaaataaaaaagaaagtgattttgtaatataaaagggacagaaactatttttaattactctaaaatgaataaccactccgattcaattttcaaaagttataccttgaatttgaattcaaagtcacccaaatgtcctcagtaaaagctctgagaatgcagtgcattcaaatgtatcctgtgagttttctattcctgtaagcaatgaacagcctagatttttctcatacgtatctcaagagatacttcatttcaaaagagcaggagagttatcaaaagtgtaatactattaacaagatacaccatagaaaatatacagaaacgttaaagataaattatatctagggagtatgttttaaatcaactttgctgttgctatggtaagagatatccaatgtaaaacaaaaatcctctataaggctttggtgctatagccatggcaacaatgatgttcaactctgcgagtgtttccatctgattcagagagaagaaaaaaatatgctttaaatgtatgtaaaatggcttagaaaatcgatcatttatggttatctttcacatgacccttcaaccaattaaagaagacattgtaaagatagcagccagagagcctaaacaaaaggctcatagatttgcttgggtttttcatgatcacagaagctggaaagatccactttagctgaggtgttggtaaatgacatattcatttagcaactatctcacagaaattttcaggttggggcctcatgtaattttccatgcataggaaaaaactaaatgcaatcaaatgacaatttctacctctttaacacaggaagagaaatattaacctaaagtaagaaaatatggaaagtggtgttctagctctgcaaaagaaaagtctcttaaatgctagtctcttaaatctactccaaataggcttttattccacctacctccaccgaatagcccttaacaatatcagcaaaatctctaccttcctgaaatgaacattcataactctcatcttacttgacctaccagctatacaattgatacagattatcacctcttggatgaaacactttcattaactcccaaggtaccacactcttctggttttcatcctacctcctaggctgttccttctcattctctgctcattccttctgtttccaaatgtggaagcattcaagtgctccagggcttggcatactgggacctctttcctgtttacattttctgtttacattaattcctttgctggccccagggtttaacatattactgaaacaactgcaacacccaagtttctgttttcaacctgacttctcccccacactccagacttgtatatcctactgtcttagttatccttatgcctccttttctctcacaccccacagccaatcacacagcgaatcctggtggctctacctttaaaatataactgcaacctgcctatgcctcacttgtccttttctccctggattattgtagcagcctcctaaccatctcctagctttcatttttgcacctcacaggcaattctcaacatagaagtcagagttatcttagtaaaactaaggcaaatcatgtcactcctctgctcaaaactcttcaatggcaccttgatccactctgagtaaaagccaggatccttacaataacctgtgaggccatacgtgatctcagacctgtggatactctgccccaattctcttaaataacataagctcctactacactccttttcccttaactgacatccagctatattgcctcttgctgttactccaatgcattaggcattcttctgggtcatgacctttgtacttgttttttctgcctgggattttcttcccttaggaagtagcccctcctccaacaccttcttcaaatatctattcctaacgaaaccttacttcataattttttcaataaggcctccatggatcacaccattttaaatggcaaccactaattcttattcccttccctgctttatagtttctccacgacacctataaatataaaaaaatatatattttacttacttatgctatcttaggaggagagacatttttgtccctatcatttcattgctatatccagaaattagaacaaaggctggaacatagtggataatcaataaacattctttgactgatggggtgaaataaatatatagatatttgcatgtgaagaaaaattcaagagtgatatcaacatagctaaatgttaacagtgattaacaataagtgactttaaaataaaataaccttttattctgtttataaaataatatctgttcattctagttattagtaaaagtaaagagagaagaaagacactcataattccaacacctaacaaaagttactattaacatttttatattttttcttttgttttttatggacattattttcccccaatgaaaataagatcactctgtttatgtaattaaaaaaaatttaaatctcacctaaaaaattgagacatgtttattttatttgtctaaaaatttattgtctaaaaaattgagacatgtttatttgtatcatatcaatccttgaaatattcaaataactgatacatttgattttgtttctctctttttataaagtacatttggtcttttatagtgactaggggaatgtgtgtgtgtgtgtgagtttttgttagtcattacttttatgttaccgaaatcatcttcggacctgttttctctgttttcatcagtaaatttttgtttctctctttataagttaatagctaatattactgagtgcttataggtgttaagtacttcagatgcattatctgatttcattcccacacaatgttccctcacataataccccataatactctggggtattatggtattcccatttcgtaggtgaggagttgaatgcttagatgttaagtaaccaatcagggttacagggttactaagtagtggagaagcacatgaacaaggtacccatgctccttactgttaaatcatttgcagttctaaaatgagggaattagcagacttgttatctctgttcccctgactccccactcatgcccacgccccgttttccaatttatattaaaatagtctgggttgtaaagtgctgatactatattactgtatattttataccttctcttttcaatttcttttagatttatagtgttacaacaatattgagaacaattagttgaaaacattttatgtcttacaagctttattttacattctagaatcctttatgctactatttcccttgcccattcttgagaatttatttatcacttgatcaactgaagtatatctttgagcaattacttcaaagagataggttgttttctaaattactgatatggtttggctctgtgtccctacccaaatcttatctcgaattgtaatccccacttgattggatcatgggggtggtttcccccatgctgttctcatgacagtgagtgagttctcatgagatatgacggttttataagtgcttgacagttcctcctacacacacactcactctctcttgcctgccgccatgaaagacatgcttgcttccccttctgttatggtgattaagtttcctgaggcctccctagtcacgtgaaacgtgagtcaactaaacctcttttctttataagttacccagtcttgggtagtatctttatatcagtgtgagaatggactaatacaattacatatctgaaaatgacttactatggtcttgcacaccttggctgggcatacaattcttgaatctcaagttcaaatccattgccctaaaaattctatatacaattccccattgtcttctgtaagtaatctgttttattaccttaatatctatctagattcttatatgactttttccttatccttgaaattataaaaatttaaaattcccttctaaaattatttatttcagaaattttgctaaattcagtaaatctgtaatttattattctaggcattctttagctcataaacaaacaatgagagttttcttttattgatgctttacttcactgctacacttttcgttctaaaattcctatcatatgcatattggatctcatggatctttcccctgtgttttatcttttctcttgtaatttttatttatacatttcttctgtctattaaatgtcttaatattctactttactgacttgggtttctcatgatccagtgtattttttgccttctttacagttttgaatttgatatgaatattattcaaccacatgaagcgtttatgatcttacagttttaacccttcatgactgcttagtctggtttcatgcagcgttagtctactgaatatcattgagatccatttgacgttagcattttggaaaatgctcttttcttaagaaaaattttacgtcaaaggatgccactgttttcattcctcaaaacgagccttctcttttgaggtatcatttaatgtctccagctctttctctatttgctcactgttgcaaagggtggtcttagcttgtctcttttggggacctgggatgagttctgtcagggacttaggaaattctccttttcacctttaggattcaaaagagagaagaaaggaaaagcttaggttaactgccagttctgccatattgcacaactctagggtccttcattcacatagtacaaatgtgcctcctgcaattgtggctggtggtggccatgttcaccgcagttttacttcattggcctagtgtagggctgttcagtagaattttctatgatgagggaaatgttctatatctgtgctggccaatatggtaaccactaaccacacatgattactgtgcacttgacatgtagctggtccaaatcaataatttaattttaaattcatttaattttattaacttaaattttactttaaatagtcacatgtagtagtggctactgtaaaggacagtacaggtctatagcagtggttctcatagtgtggaccccagaacagcagcattagcatctcctgaacacttattagaaatgaaaattcttaggccttgctctagaatatctgggggtgggccccagaaacctatacttttacaaactgtccacttgattctcactagaaatgcatattcttaggcctcacttcagaatacctggggatgggcccagcaatctatatttttacaaactctccacttgattcttaccattaatgcacattcttaggccctgctctagaacatcttggggtgggcccagcaatctctgttttagcagatcctccatgtgattctgatgcacattaagagatgagaaccactgctctactgatcacgagttaggagaggatcagaactaacagcagtcacaaaagggacttttttctctattccagtgtttcttttctatatttgaggtgagctgctaggagttaactggggcagtgtcctcattcttcgcttctcacagttgtcctcattaagaaccaactgtgacaatgttcccctcagtgtaagtgaagagtaagcaagtcatgatccttgctttccagtgggactggcaggatccaatggtacctcctcactgcccccatgtatttctttacttcgtgctttaaccttctaaagtcttctccagttactaccatggagagttcttcacatacggggaattatatatcttcagtccagttcagtcttcaatccacttcactttgccttctatcttgcaagaactcttgaaataatcagcatgtagatgtcacccattattaacttcccatactaatacagatatttttcttccttacttttatatctgttggtcatttccaaggtaatacagaaaggagtgaactagaaaaatgctttcagtcttctgcttttccaagaaatcttccatctttctcttaatgccttaccttatatgaaatattaaaagtttttcatataattctatagtgttttatatgtatcatttcatctaattaccaaaacattccagtgacataggttttattactgtcattttccagacaaggagactgaggcttacatggtttaagtgagctatataagaggaatgggtagagcatctgctttgtaagggtctctgatatgcagaaaatgatggctaacatttattggatctttattacggaccaagcattgtgataagtgttttttatccattatcttatttaaggcttataaaaatttccattttacagataatgagcaacactagaaaggttaaataacttgtctaattacacaactggttagtaaaactgcccatttccatgccctggtttgtctgactctagaggttgtgctcttaccggctatgctgtattggtttcttggcctggaaagtaatcaaatggcatgggcagagtaaagagtataacatttcggagggtgtccttacatctcatcatttatcacacagtgggttatttaatttattttccataccactaccaagtctacagtcacgggtttaagggttaatagaaacccattaatctctggtaattttaatattttgcttattttttcttactctgaatggaatccctaaaaccatatgagtcctaacttttatctccattcattctaaatatttactgcacaactactgcatgccagacactaagcgaggtgctgtgttcttgatgtttgctaggtagctgagcaatagtccctgtcaaaacgtttggtgaattgcctggtttactgttaaactctcctcccagtctgcctttgttatgaatatgattatggattcactgaaaacttcacttgaactttaagtatcataagagtatttggaacaaataggcaccttgattgcaactccaaggagttctgtggcttccttgctgcaaatttaaaagagagaactccatctccaaatcagtgacattcagacatgtgcatcactataaaggacaagggtcaactcaccatccagactagtttgacaggaacaattcagagatgaaagagctgctttcaattgctcaagcaatgaattttccatacaatgcacctttccagagtcatgatcaaaggaatccttgctgaagcctgactcacaacacagggaaataattttatgcctaattttttttctctcctgactctctctctctctctcttgctacagatatgtcagtactaatttagttcctcttataaaatagaattaaaatatcttacatttttggagcctgttattgtttataaaatatatacatttccaaggtgtaattaaatataataggataatctgtgaggcaggtactatttcccccagtttgccaataagaaaataaagattatttggctgtacattcattcattcattcattcatttattcaatcttccaacaaacatgtatcacactgaggcactagagtgacaaaaattaatcaaacaaggtccattatcttgaacagcttatagttataaaacatacaaccagacatattataacatgtgtttttaaagaagttttgtgagcttcagaggaagacaaaataaaatctttccagaaaaagatggagccttggaggacaggtaggacttagatatgcagaaatgagtgaggtgcattccaagcacaggaagcatgcacaagcaaagatatggagctcggaaagtacagacggcacaagaaaactgagttgttttgtatgtatgattgctgaaagaagacatgaagggagaatggtgaaaaataaggttgcaaaggtaggttataatgtttgagggatataagtaatctaaccaaagtaatcagcataagtgggactcaaacccaaattttactctgcagttggagctcttaccttgctagtgctatattccaaacttcttaacacagtatatagctcaatcaacttgaaaaaatagatacaggactatcaagagaactcaactcgtttttgaaagccatctatatcattctttcatttaagaactgggagatgtatattttaaggcaactgatgcacaaactctatagacagcgatctcagtatctgtcatattaaaagtaactgtgtttttctgaacactactagaattcagagcagaaatatgagtccccttgaaaaaggggacaggaagccctaagttgttaagcagttgcttatacctggatagatcttgttcactttattgtaaatggaagtgggaatcttggttgagtgaaaatcagaccggctaagttctcagttccatcaatgtttaaggcatgcaagtggtttggctgttatgcctatgtcaccttggcctcttctatgagggccacaacacagagttcaccccttgtaatttttgtccccagtgggtattcactgcctgactcagaactttgaaaagttggagacaaaggtaatgggcataaaatgacccccaactccaacacatacacatgctggtagtgatataaagaaatgtaataggaaagcataatttccttttttattctaaattaaaaaacaatcactttcctgttttatgctatagctgacacaagtagtagaaaaatttggaagcacaaactgcaacaatatgacagtcaagggcatggactcactgatgataaaaagaaaggagggtttacatttccaaatattctccacttctgttatctttttattagggaacgccatttgagacaataagttctgtctctggaataaaatctaacatggaaagcaaaatgaaatttatactccttattaattcattgtgcataaaatcaggtgtcattggttgtattgtgtaacggcttgctgaaaatcattacaaatacacacagcacaattctagtattactttaaaatcagcttccccttgaaaacaaaatccggatattttttataaaaatacattctctaattcttatctgggaaatggctcctaaatgaacagatgatacctttgcaatttgaagttaagagctgcttatttgtcactaaggcagttagttttgactatgcagttttcgttttatatcaagcaaatacatttttttattttcctgttttaaatattattttcatggttacatttatttagagaaaattatctatggtttacacataaaagacaagcatcaattgagcaaattatggcatttataattaaatgcttcttgtatgcagtctccaacactgctaaaggaagccatcactctaacaaaatattgaatatgtttagcataaaattgcattaaacagaccctcagaattcttattaatttatttgggatgaaataagcagattttttttttttttggtcacacgttttcatgtaaattcaccaattcaaaagacttgcttattattcttatttgagacggagtctcactctgttgctcaggctggagtgcagtagcgcaatctcggctcactgcaagctccgcgtcccgggttcacgccattctcctgcctcagcctccagagtagctgggaccacaggcgcccgccaccacgcccggctaattttttgtattttttagtagagacagggtttcaccttgttagccaggatggtctcgatctcctgacctcgtgatctgcccgcctccaccttccaaagtgctgggattacaggcgtgagccactgcacccggccgacttgctcattatttttaaaagcatattttacatgagtgataccggggtacttgataactgactgagccattgttccatttgaaataaaaatatggagacatttcaggtgagaatttttggcattaaaccaaagaatgatgaatagtacatttttcaaaaaagatagcaacaatattaaaaaatttaacaaacagagtcccttgattaacagagactggagtgaaagtgaggtgagactgtgtgaaactcacaaaaggccccagttaggttgatcagtggggttccaagacataactttgaaattaggcaatccttgactcttccttctctcttacctagtcagtatctcagcccatcggattttatctccttttctaaaattgaaatgctttgctctttcttactcagacttttccttttctcattatgagagctcagctcaaatatcacctcctcagagaggcctattctgatccctaatttaaagtaatcatcctcttagccctcaccccacctactactcactgcctcctacctcctccagtcattcctatctaatgtatcatcttcctattttatttacctgaggttacttatatttgttttcttgcttattttctgtccctcccactagaatgtaagatttatggaggtaaggacattccatgttaactgttgaatccctagtgcccaaactctgtggcaagtatttgaaataacacctatccacagtgtcctaattcaggtccttataatatcctgtctgggtacctgtaagagttccctggatggtttccttaatatcagcctcatcttcctcaacccattttttgcactagagctggattgttctctgtaattcaaatctaatgatgtcactccattacacaaagctcttcattggttcttcactttccaaatgaatattgtcgaaccatacagagtggtgtgcagtatcactttaagtagttcaaaaaagaatattttaatttaatagtttttaaaatttattttaatatgcgttaaaacaaaccatcaattagcacattaacgatttcacagatcttattactgaagatgagaaaaaataaaagttataatccatttacagacatggaaaaattaatgaatgtgtctttaaaagagttttgaatgtgatcagagactaatctaaaggataaagcccaatgccttctcttcagtttcacagagtccctgcctatctctctggcataacattcactacttcttgccttgcgctttatatcttggcaaattcaaattatttgcagctccgccaattcatcacattctttatggcctctctctttttagttcagttatctcctgtgcctagaatgcctttggttggctgctttctccctgtttactgtcacatggttagctcttctcattctgtgactcagctcatgaatcaccaacttcatgaagcctttgttgtttgtttgtttctctttcctcaggtttggttaggtactacttctttgttctcccttaacattctgtaaaaacgttttgtttatacctactgcattgaaaaataactatttgtgcatatctatccttcaagtgaaatattcctaagattagggataatgttttctttacattagtatccctagcttctattataggacctattctgaataggtgctcagttaaaataattagttaagagaaggggccataacatcaataattaaaaagttaaattaaaaagttgttcacccacagtatgagacacatcatatatttattcagtcagtagtcagtcaataaactatatatatatatatatatatatatatatatttactaaatgttaaaaagtatgggcacttaaaactagtttgtcgaagagataaatgaaaaggtcttagcaacatggcatagtaggacctgttggtggggaagaaggatgaaccaagactggagtgaaggaaggattgggtaatagctggaggtaacagttgattttattgattataaatgttacatctcatcagagatggtaccacagtccatacttaccaaatcaaaggtgcatgtgggaatgagaattggtggtgctaatagaatacatgtcagtgaaactttcagatatcagatgttctgttttttgtctttcagttgggagatggaatcagtgattatcaatgttcacctgataacaccgcaaaaggggccagggcaaactgctagtaggaactgtgcagagaccctagtatgaaaaaatttattcaataaacagtgtcttctatggaccaaacactgtggatatagagatgattccagtatgatattattatggtttataatgaccataagtgattgctataaaagaagggaactgttgtcgagcttcagagctaacccagggattacatctttgttagacataatagattaaggccatgtgactagaacactcttttcagaaaactttgttagtgcttgagaaataacattaaaatccaagcaaaagacaattctgggaaaatgatgaagtaggaagcaccagaaatctatctccctgcttagacaataattgctctagcagaatctgtctactataactattttggaactctggagtataatgaagacttgaagcgtccaggagaaggataattgggatatccatcatgttaaacatttatcctgatttgaccaatacacactgtacacaggtatcaaaatattacatgtagccccaaaatatgtacagctattatatatccattaaaaatgttaaaaataaaatttgaagtaaagaattaagtaatttcctttgcttcactaattagcagaaaatttgaacataacatacattttgggagtttggattataatcatttttaaggataaaacctataaatccctttcttctctagaccatttgagagactttttataaaaagcatcatttgaagatatgcttttatttttttcttataaagcttcaataatctcttgaagttgttcatacacttctacaatgcatttgctattccactgattattgtgcagtgctattactgaccctaccaatatctctggatcatgctacatttggagaataatattctcccatatatccaacatgcagtggtgggacaggcataggataacctctacagatagttgcaatcaaaaggagggaaaatggaagttgagcaagttactggtctgtagacattctgaaatccagttgggtgcagattgcatttcttgagtagggctccatcttattggagttgttcactattgttcttagttctactttctgggtttttgtttcctccctctgaatgatcctacttttcatataagaaacattcttatgcctgctttctgttcataaaagctcaggggcccaaaggtctcttaatatattgtactttctctgtcccttctattccaagctagggatgcttccaccagaataattatctaaaaacattgtgggatttgtgtttactaattgacaattcgcacaattagataaatgtcatatccacaaatctttctgacataagtctttgtctaccttgagttccctgtaagactgttgtatgactctctacaatcctgtccaacccacggcccatgggctgcatgctttgaatgtgacccaacacaaatttgcaaacgttcttaaaacattatcagattctttttttttttttgcgattttttttttttttttttttgagacggagtcttgctctgacacccaggctggagtgcagtggcacaatctcggctcactggaacctccacccctccaggtttaagcaattctctgcctgagcctccggagtagctgggattacaggcgcgtgccaccacacccggctaattttttgtattttttgtatttttagtagagacggagtttcaccatcttggccaggctggtcttgaactcctgacctcataatccacctgcctcggcctcccaaagtgctgggattacaggtgtaagccacggcacccggccttttttgtgatttttttaaagctaatcagctattgttagtgtattttatgcatggcctgagacaattctttgtccaatgtgtcccagggaagccaaaagattggacattgctgctctgcaatgcccttagattctcagaacccttattttttagggcggaggagactcaaggcatgcccttaaggtcttaggtcttctgtcatctgaaagtttctatgagtcactatatttgatcttttgagggcttaataaggagttttgtaagcatacccagggattacaccttagactttacttccctgatagcgctctggatttgaactctgacccagagctatttattaattttagtttcatttgacatctggagagactaagaacaaaaaccactttttttttgtacaaataatcttgccccctttgtaatgaacagtctgttcttttacttatctctgttttctcacattttgtcatctaacaagaagaagacaggtggcactttcaataatctgcctggaaatcttagattgtcattagatacttttactattttccatgttattgcaaccaacagaattgccagacattctgccaccatattacaaaagtctcctttcctccagcttccaatcacattttccatactttcctttaagctcccagggacgatctacccagcgcttctgctaacacctgcctttttagtctttccccaacattcttcatgaagcactttcactaacactttttcaatgcccttttagtttctgcctgctacttggttcaaaacctacaccatatgttataggatactataatatgacatgataatagcatcatatttccaggtattaaaatttgttctagtcctctattgttacataaaatagtatcttaaaaatgcagtttcagtaagacagtggatgggactggggtcaatgcaaaggttttctcactcacatgtttggtggttaatgctggctttcaaatgagactttacttgggttgttagccagaacagtacacaggacttctccacatggctattgtgcttccttaaagcatggtggctgggttctaagagtgagatttccaaaggaccaggcaaaatctacattgcctcctatgaccctagtcttgaaggtcactttttaataattgtttttattttaaaatttttgtgggtagatagtaggtgtatgtattaatggagtaaatgaaacattgtgatacagccatataatgcataataatcccagaaggataaatggtgtatccatcatatcaagtatttatccattctttgttttataaacaatttaattctacctttttagttattttaaaatgtacgataaattaatgttgactatcgtcaccctgttgtgctatcaaatactagattctattcattgcatctaactactttttgtacctattaaccaccccctgtccccactatccttcccagcctctgataaccttcattttactctctatcttcatgagttcaattgttttgatgtttagctctacaaataagtgagaacatgcaaagtttgtctttctatgcctgtcttatttcacttaacataacatcctccagttccatctgtgttgttgcaaatgacaggatctcattcctttttatggcttaatagtactctattgtgcatatgcaccacattttgtttattcatttgtttgttgatggacacttaggttgtttccaaatcttggctattgtgaatagtgctgcaacgaacatgggagtgcatttatctcttcagtatacttcttttggggtatatacctggccacttagtgtcacttgtgccatagtcactggctataccatattcaaacataaatataaatctcacctcttgatggaaaaatgtcattatcattttgtaaggaaaatgtatagatggaaagatgttattgtggtcatccaaaatacaatctgtcacagtctgtgatagctaacctgctaaattcatcttcagtctcaattttccattaaaagaaaagaaatgattttgagtgacactagctcccagtgtcagcaatttaaaaattaaaatgaacttgatgatgcttccctgagaatgccagaagtagtaaattaagaagtaaacttttcaagagaaaaaactgtcctggatctaaaagagtaggaatacagacaacaatactccctatgccagaataatttagcatgcttactctgttagattttactgagtccttacttagcagacaaaggatgaggtttattactttttgatgaatgagagttgagttagagaagctctgggtgaatatttcatctcactagacggtttgggacattaaattttgggcattaaattatgtccccatctcctcccgaaattcaaatgctgaagctctaactcctagtagcttagtgactgtatttggatataggccctttaaagtgatgtatttggatataggccctttaaagtgatgattaaagtaaaatgatgctgttatgatgggccccaattcagtattactgatgtccttataaaaataggaaatttggacatgctgagagacacttgagatgtgtttacacagagtggagggccaccatgtgaggaggaagcaagagggtgagcatctctctcacctataaggagagagacttcaaaagaagccaaccctgctgcaaccttgattttggacttccagcctccagaactgtgagaaaatacatttctactgtttaagccacccagtctgtgatattttgttatggcagccctagtaaaagtatacaccatttttaaagtaaggataataaaaccttcttctgacgatggaatcagacatttaaaaaacatcacactgtgcctgccattttataggtagcagatgaagaaatcaccctttctgtaataagattgtgctacatatcagtcagtagagaaaggtgaaggctcaacaaatatggaggccctttaatagtcttgtaatattttacttctctggatgttacatgatctctgtatagttccttaatattttattagataaacactgtgacccctttttgaagtcacctaacttacgtctacattcccctttcttgccgaatatcactaggtcccttctcccctacctgtcatgagggcttacttcctaacctgatgatcacagagcagttcttgaaaggagtcttgagataccttcaagtacaaaagagaacttgttattttgatgtattaaaaaactgagacgtgatagtctccaggtgccatctgataagcactccccctcatccattcctatctgccatgtagttcttagtaaatgacaaagtcttattttaaaatgtgactgtgtttatttcccactgagtacccaatgaaaggaagatcacccctatttacccttaccatgaattaaaagcaaaaacaaaatcactggattcctccacaggccatgtaagaatcatgttatcaaagctactttggtgccacatcgaaaaatggcagctgagaatccaaggaaatattgattttaccagcagaaaagggtctgtgaaaattaaaaagaatattgtttattggagagaaatataaaataataaaataggaggctctaaagctatgtgtacacatgaaatgttgaagatagaaccaaagatgcacttgtgggttagtaaagagttcttccctttacttctgaggctcgcccagttctacagaagtccttgagtcctcggtactgttcagtagtttgggaagcaaaactgaaccctatgcagtcaagatctggttcaagatagtatgtgcttttgaactggtatgagtcactaactggtgctgagtcttaagggaactcagagaaaaaggtaagttcttgatcactgtaaggttgaatacacatttatggggtggaacagaccagaccattgtgaagtattgccccatagactattcctgaataggtctcatctggtagcctgaacaatagatatttgtctttcctattcaggagataatttgaacatgctttgtgatcattctcagcagattcacttgatttgtgagcaaactgatgaaagtgataatccacagacctaattctacattttaagagataaaagataaaactcttcaagcgaggatattagaaatcaagctgtctgccaaagattaatattcccttccacagaatggagccgctgtgttgctgggaagcagctgcccatcaggaattacatttctctagctcccttcatttaagtgggaccatgtgacagagagctggccaagagaatgcaggcagaagtgatgcacaccacatacaggcctggcccaggggaaactttcatgcagtcttccactgtctttcccatctgctggctagatatcaacactgaggctgacttcggaagccatgtgttgaatcctgcaaggtctctgtatgaacccctgtgtccaggtcccatcatttggactttacataagcaaggaaaatatttgctattatgataaaccactacaattttggggatgtgtctgttcccacagctgatatttatcttaactaatatggacagagacataggaaaaaagaagttccccaaatatattttgtttccatatgcttttgtgtaccctcttctgcacttcctccccctctttgattcttacacatccttcaagaccaaggtcaggcatcacctcctccaagaagactttgaaacctccccaagctgagttaaatatggatactgcatgaaggattgtaatcttctgtgtatgtgatcatgtcccaatatctaacaacctaactggtacatatttgtaaaattaatatgtaaattaataaaataaatggagaaaggtaaatacttcaagcaaaaaataaaaagtacaagtcatcctgaaaatatgaaaggaaaagtctctactggctgtggacaatgtaattgcattaaatatttaaaaatatctaggtatgactagcctttctgctgcttcatatgatcttgtattaacctaaattattgcacccaaaatgtagcatatggcacttggtacaaatctgactctttcactagattgcgaatcccctgaagacaaagactgtggttttctttgtgtttccattttcaggtcccagaatggtgcctgaaatggtgtaggccctcaccacatgcccattcactgactcgttgactcactgactggctccaggctggccttgaattcctgggctcagactatcctcctgcctttgtccttttgttctgagtcttcctcagcattttctgccaacccttcttttcaggctgacatgggttaggaggtaatctgaaagctttcaccaataagaaaaattaattgaattacatcagctctattataaggaaaagggctattgagatataatctacatactgtaaaattcatctgtttaaagtatacaattcaatgatttttagtgtacttagagaattgtacagccactcccataatctaattgtagaagatttccatcatccaaaaaagaaaccttgcagcagtcactcctcattcacactcttcccacccccagccctaggcaaccactaatccagtttctctctctatagatttgcctattctagacacttcatataaatggaagcatgcaatctgtggggtggggtggggggaggttgtagaagctttatcttttgacaaatgctgattagccttgtaaagtgcagttgaatattatcaaacatgttctcaaaatgaacaaatataggaataagatgggggtttctataactgtctaaattactgagaaataataattaggggttgggcatggtggctcatgcctgtaatcctagcactttgggaggccaaggtgggtggatcacttgaacccaggagttcaggaccagcctaggcaacatggtgaaaccccatctctaaaaaaattagctgggcatgtggtgcatgcctatagtcccagctacctgggaagatgaggtcggaggatcacctgagcctgggaggttgagggttcagtgagttgtgatcgcacaactgcactccagcctaggtgacatgagtgagaccctgtctcaaaaaaataaaaataaaataaataataattaaaggaaccagcagctcaaaatatattataaacaattctcataattgatattttatccaaatatcaaaaattcatacatttttcagatgaagggtctccagagaaacagaaccaatagagtctgtgtgtgtgtgtgtatgtgtgtgtgtgtacgtgcatgtgtgtgtgtgagagagagagagaaagagaaagagagattgttataaaattttataacaaacactaacatcgaggaatgctagtgagtagacatgcagctatatggtttggcagggcctgccagtgctcaccataaatgtcttctccttgtcttgctggatacataatctgactctcttcctcaactgtcctttataggtaggtgaccatattagttagttctggacaatggaatataagcacaatttatgtaagcacaagttatgtgttttacttctgggctgccatggtacattttatgttaacctgatggggccacagagtgctctggtttttggccaaacattattctaggtggatctgtgagggtgtttctggatgggactaacatttgaactggtagactgagtacagtagattgccctctctaatatgggtagggcaatcagttgaagactaactagaacaaaaaggccgagtgaaaaggaattcccattacctgactgcctttgggctaagatgttgttttcttttctgctttcagacttggatggcaacatcagctctcctgggtctccagcttgctgactgcagatcttaggatatgtcagcctccgtaatagcatgagccaattccttataataaatctctctctctctctctctctctctgtctgtctctctctctctctcacacacacacacatgcacgtacacacacacacgtgcgcacatacacacacacacacacactctctctctctctcgctattggttctgtttctctggagacccttgactaacacatgagcctaaaccataaccccttccacagagaatccttgctctcttctctcatctacttactgaatggatggagaggatgctatgaacctagggaaaggtggggccacaaaatggtaggcatctggggtccctgaataaagcataagaagagagctgcctagtctaccttcattgtactgcaacatgaatgagaaataaacacttattgtgctgatccactcagagtatgcggtttatgtattatggcagctagtggtatttactgtagcatttattacatgctagatttttatgaaattgaagggtaattcactcaagtcaaaatgtaactaaaaattaactgtttcagtggaatgaatacctctttgcttgtgaattttcaaaattaaaagagaaaagtctgagtcatgaactgatagtagaggggtgctttaccatgaccagtgttctggctcacatgaagccatggagtctagcccaagtagctgaattcagtggcaatgttcagatctgactcatccagtctggctcttcttaagagacaaagaacaaatactgtctgttggcgggtacttccaaaataattagcaagcaccagcatacttttattatttttttctggctatacaaacgcccataactagtatatcaaacttcatgactgtgaaaaaataaaagaacttgtgaaaagtaagaaacattttgccaggaagcaatttcattaatagagaagtagaattgtatactaggaggaacatgggctttgaaagtaggctgtcataggtttaattcattcatcactattaattaattcatcaattaaacaagtgtgtactgagaacctactaaattgaaccataaagatgctgatactcaactttatttgaactacaaaaataatggttttgtatgattcagtctaatacataacagccactgttgtatgtgctgggccttcagtaagaataaaacaaagttcctgttctcatggagattaccttttagtggtgagagatcaaaagaaaacaagtcaaatgtatagtatgtgcagtaataatacaggcaattaagaaaaatatagaaggtaaggaagatgggtgtgttgtgaggggaggaatttgctattttgtggtagtcaggaaagcatctttgataaagccatgtttgagtagagaactgtaggaagtgcagaaataagccatttggctacctgggagaagagcattctaggcagaggaaatagcaggtgcgaagtccctgatgcatgactatgcttggtatgttcaagaatagcaatgccagtgtggctggagcaaagtgggcaaaagagagagtagtaagggatgagatcagcaaggcataggactacctcatgtaaaccttgccttacttttatagggcttctggttttcactgatttaagagttgaaaaaccttggagggtttgggggagagatgtgacatgtgttttcaaaagactactctggctactcttgtgcgaatagactgtagggaagagaaggtcgaagcaggccaattaaaaggctattattcccctaatccaggcaggaaaagaccatggcttggtctaaaacattaggtatgcagctagtgagaagtggttagcttttgttctatgaacgtagaactaacaagatttactgatgtatcggatgtgccatatcaaaaaaaagaggtgctaaaaatgttctgagcaagtgaaaaggatggagttttcattaactgacatggggaaacctgaacaaggaagaggttttatggctgtgagaatttagagtttcgttttagacatttaaagggtgaaatgcctactagacattcaaatggagaggtcaaatagtcaagtaggcagctgaatacaacagctgcagagagactcaggttaggaatataaactttggagtcatcagcatgaataagacaataaactattgaggttaattgagaaaaaaagaaaagaaatagcggagacaagaactaagcctggagcattctgacgtttaggggtcaaagaaaagagaataaaaggaagcagctggggatgtcagaagagatgtttagaatgcaagtcttcattcttatgagacctctccaggtttcagtttccataagtgaaaaatacagaaaataattcctaggtcagaggatttccaaaggctgaaaagaagtaacatgggaaagcatacataagatctagaatgtgcttaataaatgttattcctgactcttggtgaaattctgggtagatgccagatttctcatgcttccttctattttttggctcctcaatcaggtcctcaaatatgaaccctatagtccaacagtgttggctatggaagtaagagcctcattattcttcagttattagttatacatttttcagtgatagagctcactgttatcagatattcatctttactgtttgttctcttcctgtgttttgtgaggagtcaggtttaaaggagagtggtcactaatgtgaagctgggaaaatggagggaggatgagttctttatcacctggcaggagtgtatccttacttcaacatttaactgctcaccaaataatttaatttcagaggatttgtttcagtgctatggaagaactatctgtatataaatagctgggttaagtagatctttcactgcagctgttaaaacctattgttgtagctagacaccttgtagtgattcaagatcatctgtctttgaagaaagtctatgctttcttttatgcacatgtagtttcttttagttctgaaaataaaataagctttacttaggaagactaaagaaaatgtttactgaataaaccaggggtagctgaaataataccctgccacaatctcctgcttttatttcatttatctgctttcaacatttaccactgaatacttattgaaagaataaaggaaaaactaaatgaatggatgaattaatatctgaatggcttttttttgcttttccttaacaagactcctcctaaataatcctaaataagttctgggttaccctgaggattatcttttacaacaagaatcatgaagtaggaatactttttcataaagaagagataaatcccagagtaacaccgaaacttacctagtaaagtagtaaacaatctgtagggaatctcaggggatcatctgatcctagtatcaggctcaagcagattctttttcaagttcttatccctcctcctcttccccaccccaacccagttggatttaaattgtgtatattagagcctctttgtaaggaagaattgggcagcagtgcagagagaaggaagagttgggtgctttaccctactgctagcacttgggtgctcaaagtagagaaacaagaaaaacaggctactggtaagatggacaataaaatgagctgcattgggtgaactgtgacctagattataacagtgctttacaaataatattccaaattataagtccctaaaattatccaaatctagattttaacaatcccgaaagccattcattttagaaagattttattttcctgtatccttccctccatttctactcctgccaccttagtccaaaccagtgttttttttcttgccaggacaatgacaaaagcttttcaaccagtctcttcattgcttctgttgctcttctgtaatccattctccatgtagcacttggaataatccgactaaaatgtaaatcaaatcaaatcatttctctacttacaatctttcaatggctccctatagtacttggaacaacgtccaagctcctccctgtggtctttaaggttttttgtgatccggcccctccctgcccctctaacatcatattgagtcattctctccttcactattctccagctacattgacatccttttacatgtatggtgcttgtgtatgtttgtacatatctatatagtgtatatacatataactattttttattaggatataattggcatacaataaactaaacacacttaaagtgtataacttaaagttttcagatttagatatatgcatgaaaatataaccacaatcaacaaaattggcatatctatcatccaaaaatttccttttacccttttgtaatttctcactcatgtccctcattatcttctcatccaccaggcaacaaacaatatgctttctgtcactataggtaagtttagcttttctagaattttatctaaatgaaattatacagtatatacttttttgtctagctgcctttactcagcatagttattttgatatttatccatgttgtttatattaatagttcattcctttttattgccaaatagtgttccattgtatggatatagcataatttatttatccattcacctactgatgaacatttggtttgctgccaggttttgtctattagaaataaagctactatggacatttgtataaaactcattctatcgccatttgttttcatttctcttcaaaaaatatctaggtataaatgaccgagtctagagaaggtgaagcaaaatgactgaatagaactttccagcaattgttgcccctgcagaataccaaattgaataaccatccacataagaaaacaccttcataagaaccaaaaaccaggtgagtgatcatagtacctggttttaacatcataccaatgaaagaagcactgaaagagtatgaaagatgttggcgccacccctccctcatcccctggcagtgactgtgtggcatggagagagaatctgtgtgcttgggggaggaagagagcagtaattgtgggactttgcactgaaattcagtgctgtgctgtcataacagggactaacacagggcagaactcagctggcacccaaagagtgagcatttagaccagccttagccagaggggaatcacctagcagtattgtcagaattctgacaagcccaaaaacaagctaaagcgctctggagttctaaataaacttgaaagatggtctaggccacaagaattgcaatttgtgggcaagttctgatgctgttctaggctcagagtcagtgaatttggggtgcatacaacctagtgagatgccaaccacaggggcaagggaatgtttgtgccacccctcagccaactccaggcagcacagcttgcagctccaggattcacaccttccttctgcttgagaagaagagaggggagaggaggacttcgtttttcaacttggataccagctaagccacagtaggacagggcaccagggagagtctgacagccctcattccaggtcctggttcctggacaaaatttctaaatatatcctgagccagaagataacctgcttccttgaagggaaggacccagtcctggcagaattcatcacctgccagctaaatagcccttgggccttgaatgaacatgagcaatacccaggcagtacttgtcataggccttgggtaagacccagggccacactggctttatgtgtgactgagtgcattcccagcagctgtggccttgaggagagaatcctgtttgaggaaaggagagggaagagtaaaggggactttgccttgtagtttgggtatcagcttagccacagtggagtagaacatcaagcagtttccaagggtccccagttccaggccttggttcttagatggcatttctggatccatcctgggccagagtgaagactactgttccgaagggagagatccaggcctggcagcattcaccacaagctgactgaagagtccttgggcctggagcaaacatcagcagtaaccaggcaatcctcactgtgagcctagaacagtggtggccacagcgagagacttcttctgcatagaggaaagagtgggaagaatgttgtcttgtggtttgggtgccagctcagccacagtagaatagagtaccaagtagattcttacgtttcctaactctagacctgggctcctaaatggcatttcttgtcccactctgggccaggggggagctcaccaccctgaagggaagggcataaacctggctacatttgctgcctgctgactgaagagcctttgagtcttgagtgagcatcggtggtagccaggcagtggacacctcaggacattgacaagacccagtgttatgctggcttcaggtctgacacagtacagtcccagtgatggtgaccataggggtgcttgtgtcaccccctctgacagctccagggagcccagcatgcagagagagactccatttgtttggaggaaagcgagagaagagaacaaatctctgcctagtaatctaaggaattcccctggatctcacctaagaccaggaaggtggtatttctacaagtctgtaagagtcccagtgttactgagcatggagtgccccctaatgcagatattgcaacagtgactaaagatttagatcataacacttgaatacttggaaagccttcccaagaaggatgggtacaaataagctcagactgcaaagactacaataaatacctaactcttcaatgcacaaaaataaatgaacacccacaagcattaagaccattcaggaaaacatgacctcacaagacaaactaaataaggcaccagtgaccaatcctgagtaagagatatgtgacctttcagagaattcaaaatacctgtttttaggaagcttaacaaaatttaagataacacagagaaggaattcagaatcttatcagataaatttttaacaaagatattgaaataatttttaaaaatcaagcagaaattctggagctgaaaaattcaattgatgtacaaagaatgcagcagcatcttgcaatagcagagttgatcaaacagaagaaagaattactgagcttgaagacaggctatttgaaaacacagagtcatagaagacaaaagaaaaaagaataagaaagaatgaagaatgcccataagatgtagaaaatagcttcaaaatagcaaatctaaaagttcttaatctttaagaggaggtaaagagagagatcagggttgaaagtttattcaaagggatagtaaaagaaaattttccaaatctaaataaagaaatcaacttacaagaacaagaaggttctataacaccaagcaaatttaacccaaagaagactactttaagtcttttaataatcaaactcccaaaggtcaagtataaagaaagaaacttaagagtagcaagagaaaagaaacacatagcatacaaaagaacttcaatatgtctggcagcagaattctcagtggaagccttccaggccaggagagagcggcatgatatatttaaaaggatgactgaaaatgcttttatcctagaataacataggtgaaaatatccttcaaacatgaaggagaaataaagatcttcccaggcaaacaaaaggtgaaagatttaaccaacatcatatctgtcctacaagaaatgctaaggagagttcttcaatctgaaagaaaataatgttaatgagcaataagaaaacatctgaacatacaaaactcactggtcataataaataaacagacaaacacgtaatattagaacactgtaactgtggtgtttaaagcacccatatcttgagtaggaagactaaaagatgaaccaatcaaaaataataatggggtgataaagttaaagtgtatagagttattagttttctctttgcttgtttgttaatttgtttttgcagtcagggttaagttgtcatcagtttaatgtaatgggttataagatgttatttgcaagcctcctgataacctcaaatcataaaaaaccctacaacaggtataaaaataacaagaaattaagatatacctcctgagaaaaccaccttcactaaatagacaaagggaggaagaaaggaagagaagaccacaaaacaaccagaaaacaaataacaaaatggtggtagtaagtccttacttatcaataccactgaatgtaaatggactgaactttccaatcaaaagacatagagtggctgaatggatgaaaaagcaagacccattgatccgctacaagaaaaacatttcacctataaaaacatttcacctataaaaactcatcgagactgaaaatgaaaagatataaaagatatttcatgcaaatgaaagccaaaaaaagggcaggagtagctgtgctcatatgagacaaaataagtttcaagataaaaactacaaaaagtgataaaagggttattatataacaataaaggtgtcaattcagtaagagaatataacaattgtaaatatatatgctcccaacactggaggatcagatatgtaaagcaaatattatcagagctaaagagagagacagatcccaatacaataacagctggaggcatcgatgcctcactttcaacattggacagatcatccagacagaaaaatcaacaaagaaatatcatagttaatctatactatagaacaaatggacatcatagatatgtacaaaacatttcatccaatggctgcagaatacacattcttctcctcagcacgtggatcattctcaagtatagatgatatgttaggtcacaaaagaagtcttaaagaattaaaaaatattgaaatcatatcaagtctcttctctgaccacaatggaatgaaactagaaatcaataacaagaagaatgttagaaactatacaaacacatggaaattaaacaatatgcttctgaatgaccagtgaattaataaagacattaaaataaaattttcaaaaattattgaaacaaatgaaaatggaaacacaacatatcaaaatctatgggttatagtaaaagcagtactagagaaaagtttctagcaataagttcctacatcaaaaaagtagaaaaactttatataaactacttaattatgcattttaaagaactagaaaagctgaaaagctagaacaaaacaaacacaaaattactagaagaaagcaataataaagattagagcagaaatataacagaaacagaaaagaataatacaaaacgtcaatgaaatgaaaagttggttttttgaaaagataaacaaaaatgaaaacttttagccagactaagaaaaaaactaaaaaggcctaaatacaatcagaggtgaaaaaggagatactacaactgatactccagaaattcaaatgatcgttagagaattctatgagcaactctatgccaataaattgaaaaatctagaagaaatggataaatgattatacacagacaacctaccaagattgaaggctgaagaaatccaaaacctgaatagactagtaacaagtaattagatcaaagccatactaaaaagtctcccagaaaaaaaaaaaaaaaaggcgtggacctgatggcttcactgctaaattctaccaaatatttgcagaagaactaataccaatcctactcaaacaattctgaaaaataaggggactacctctaaactcattctatgaagccagtattatgctgatatcataaacaaagacacatcacaaaaagaaaactacaggccattatccctgatgaacattgatgccattgatacaaaaatcctcaacaaaataagagcagtccaaattcagcaacacattaaaaaggtcattaatcatgaccaggttggatttatccctggaatgcaaggatggtttaacatacacaaatcaattaatgtgatatatcatatcaacagaataaagggaaaaaaacataaaatcacttcaatagatgctgaaaaagcatttgataaaattcaatattccttcataataaaaactctcaaaaaactggggatagaagaaacatactttaacataataaaagctatatatgacagactcacagctagtataatacttaatggggtaaaactgaaaactcttcagttttgaagatctggaacaagacaaggatgtcctctttcaccactgttattcaatataatactggaagtcctagtagagtaatcagacaacagaaagaaataaaaggcattcaaatgggaaaggaagaagtcaatttatccttgtttacagatgataaaatcttatatgtggaaaaacccaaactaattcagtaaagtggcaagatacaaaaccaacatacaataatcaatagcatttctatatgccaacagcaaacaatatgaaaaagaaatcaaatcccatttccaatagttatgaataaaataaaatacttaggaatagacttaaagaagtgaaagatatctaaaataaaaactgtaaaacactgatgcaagaacttgattgaagaggacacacaaaaaaatggaaatatattccatgttcagggattggaagaatcaatattgttacaataaaatgctcatactaaccaaagctatgtgcagattcaatgcaatccctatcaaatatcaatgacattctttgcagaaatagaaaaaaaatttcctaaaattatatggaaccacaaaagaactaggctagccaaagccatacagagcaaaacaaacaaaactggaggaatcacattaccagacttcaaattatactacagaaatattgtaacaaaaacagcatggttctagcataaaaacaggcacatagaccaatggaacagaacagagaacccagaaataaattcacacatgtacagtgaacttatttttgacaaaagtgccaagaaaacacattggggaaaggacaatctcttcaataaatggttctgggaaaactggatatccttatgcagaagaacaaaactagaacctatctctcaccttataaaaaatcacactacctgacttcaaactatactacaaggctacagtaaccaaaacagcatggtactggtaccaaaacagatatatagaccaatggaacagaacagaagcctcaaaaataacaccacacatctacagccatcttatctttgacaaacctgacaaaaacaagaaatggggaaggattccctgtttaacaaatggtgctgggaaaactggctaggcatatgtagaaagctgaaactggatcccttctttacaccttatacaaaaattaattcaagatggattaaagacttaaatgatagacctaaaaccataaaaaccctagaagaaaacctaggcaatatgattcaggacataggcatgggcaaggacttcatgactaaaataccaaaagcaatggtaacaaagccaaagtagacaaatgggatctaattaaactaaagagcttctgcacggcaaaagaaactaccatcagattggctgggcatggtggctcacgcctgtaatcccagcactttgggagggcaagatgggcagatcacgaggtcaagagaccgagactattctggctaacacagtgaaccccatctctactaaaaataaaaataaaaataaaaataaaaataaaaataaaaataaattagccaggtgtggtggtgggtgcctgtagtcccagctactcaggaggctggggcaggaatgaacctgggaggcggagctttcagtgagccaaaatcacgccactgcactccagcctgggcgacagagcaagactccatctcaaaaaaaaaaaaacgaaacaaaacaactaccatcagagtgagcaggcaacctacagaatgggagaaaattttcacaatctacccatctgacaaagggctaatatccagaatctacaaagaactccaacaaatttacaagaaaaaaaagaaactaccccatcaaaaagtgggcaaaatatgtgaacagacacttctcaaaagaaaacatctatccagccaacagacacaaggaaaaatgctcatcatcactgggtatcagagaaatgcaaatcaaaaccacaatgagataccatctcacaccagttagaatggcaatcattaaaaagtcaggaaacaacagatgctggagaggatgtggagaaataggaatgcttttacactgttggtgggagtgtaaattagttcaaccattgtggaagacagcgtggcgattcctcaaggatctagaactagaaataccatttgacccagcaatcccattactggatatatacccaaaggattacaaatcatgctactataaagacacatgcacacatatgtttactgcagtagtattcacaatagtaaagacttggaaccaaccccaatgtccatcaatgatagactggattaagaaaatatggcacatatacaccatggaatactatgcagccataaaaaagggtgagttcatgtcctttgcagggacatggatgaagctggaaactatcattctgagcaaactatcacaaggacagaaaaccaaacaccacatgttctcactcataggtgggaattgaacaacgagaacacctggacacagggtggggaacatcacacactggggcctgtcggggggtgggggctggggaagggatagcattaggagaaatacctaatataaattacaagttgatgggtgcagcaaaccagcatggcacacgtatacctatgtagcaaacctgctcgttgtgcacatgtaccctagaacttaaagcataataaaaaataaaataaaataaatcaaatcaaaatggattaaagacttaaatctaagatttcaagctatgaaactactaaaagaaaatggggaaactctccaggacattggactgggtaaaagtttcttgagtaatatcccatgtgcacaggcaagcaaagtgaaaatggacaaatgggatcacatcaagttaaaaagcttctgcaaagcaatggaaacaattaccaaagtgaagaggcatcctacagaatggaatacaatatttgcaaactattcatctgacaaggaattaataaccaaaatatataaggagctcaaacgactctataggatagaaacctaatactctgatttaaaaatgggcaaaatatctgaatagacatttatcaaaagaagacatacaaacagcaagcgagtatgtgaaaagatactcaacaacactgatcatcagagaaatgcagatcaaaactacaatgagatagcatctcaccccagtttaaatgatgtttatccaaaaatacgagtaataatgaatgccagcaaggatgtggagaaaagggaaccctcgtaaactgtttgctggaatgcaaatttgtacaggactatggagaaaaatatgtaggttactaaaaaactacaaatagaaccaccatatgttccagcaatcccagtgctagttatatacccaaatgaaatgaaataggtatataagacagatatctgcactcctacatttattgcagcactgtttacaatggccaaaatttggaagcaaccttttgtccatcaacagataaatggataaagaaaatgtggtatatacacataatgtagtactattcagccataaaaaagaatgtgatcctgtcatttgcaacaacatggatggaactggaggacatcatgttaagtgaaataagccaggtacagaaagattaacttcacatgttctcacttatttgtgggagctaaaatttagaacaattgaatccacggagacagagaatagaatgatggttaccagaggctgggaagagtagtgggggcaggaggagaaatggggatggttagcggatacaaaaatacagttataaacaataattaacatttagtaattgataacataacagggtgactacagtcaacaataaattattgcacttcttttttttttgagacaaagtttcgctcctgctgccgaggctggagtgcaatggcgcgatcttggctcaccacaatccccgccttccaggttcaagcaattctcctgcttcggtctcccaagtagctgggactacaggcatgtgccaccacgcccggctaattttgtatttttagtagagacggggtttctccttgttggtcaggctggtctcaatctcctgatttcaggtgatctgcccacctcagcttcccaaagaattattgcacattttaaaataactaaaagaatataattggaaggtttgtaacacaaagaaataataaatgcttgaggggatagatagcccatttaccctgataattacacattgtatgcctggatcaaagtatctcatctaccccataaatacatacatgcactacgtacccataaaaaaattggctgagtcatgtggtaggtagatgtttaacatttaaaaatacagccaaaccattttccaaagtgattataccattttatattcctaccagcaatgtatgagagttccagttactccacatgttcactaacacttggtatgatcagctgttaattttaaattttgtaacaggtaaatattagcccaatggctaatgataggaagtattttttttcacatgctgatttgtcatctgaatatctgcatatcttctatggataggtgtccattaaatcttttgctcatttaaaaaaattgtcatttgtttccttattactggatttgacagttcttcacattttccatattaactcctttataagatatgataattggaaacatattctcccagtcagtggtttgtcatcactgtctttgcaatgtttttcagaaagctgaagttcttaattttgattaagttcaatatatcaaatttttcttttatggattatactttcagtgtcattcttttaaagttttattttaagtccaggggtacatgttcaggtttgttatataggtatacttgcgtcatgggggtttgttgtacagattacttcacacccaggtgttaagcctggtacacattagttatttttcctgatcctcttcctcctcccaccctccaccctccaaaaggccccagtgtgtactgttcccctctatgagtcgtgtattctcataatttagctcccacttataagtgagtacatgtggtattcagttttctgttcctgtgttagtttgctaaggtgtcatttttaagaaatctttgcctaacccaaagtcacaaagtgtttctcttatgttttctgctagcaattttagagttttcggctttatatttatctttgcaaaatatttaatttttaatatggtataaggtatagatgagtgcttttatccttttttttgaaaaccatatccaatttttccagaaaatttgtggaaaagactttcctttattcattgagtcaaacctttgttaaaaatcaattaaccatataaatgtggatctgtttctggactctgtattttgtttcattgatctatttatttttacattgataccacatggtcttaaatatcatgactttatactatatcttgaagtcagttggtgtgtcttacagctttaattttcttcaaagttgtttttaaattattctgcatttccatatgaatgtgaggatcagtttgctaatttctacaaaagcctgctgggattttgattgggttggcatcttttctggtcttttaaaattaaaagcttatcatcactttaagacttttgtattttgttcattggttcatttatcttcttttctctttacagggatctttcgatggctggctcctttgtatcattcgtatttcagctcaaaagtaacatcctcagagatatctttccttgattacccaatttaaatttatatccctcatctctttatatcaaagcattgttttgttgacttaacagcattaattatcatcagaaattaatcttgcctatttgtttattttgttgcttattatctgtctagccaactagaatgtgagaaaagagtagagaccttgcttgtcttattcagtttgtatccctgaagccaaaaagtgcctttgataagcggatactaaatatttgtcgaatgattgactatttgacaaatgtgcatttaagtaaagattcaactagtatgaaaatatataatattaactagaatatgttaacttatttatgaaatgatagttctctgggaagactgtgggaacttgactgtgacttaaagctgtagttctcttgaagattatgaattgcgttgggctagattatggcatttcagaaacatagatttttggtttttaaactaaacatctcaatttagctcattagctttgttagcagaatttaaataggtctcacattagagttattcctgattactttaggaatgtgaatatctagaacaaataaaatctttccccaaacattacacagataaaaggcagaaagtttcaggtccatgagaaattataggtatttcctaaataatatttaattaaaaataaatactagtcataattttgacagacagaggcagcaattaaaacatacttcatttttgtccttgattgcttaaagtagcaaacaatgaaatcaatttcttgagccctatccatgttgcaaaggtataaataagattttatccttaatgagatcatacaacacagatacaaaacctaaggctgtttcaaaatgttttgtagtagcgtaaacatagaattttatttgctgagctatttctctcactgagaaccttcattcattgaacccaccaaacttgtgttgagcaccagctacatgttaggaactgtgctaggcaatggagataagaaatgaataaaacagagtctcaatccttcaagaagtcacagattttacaatttcaattgcttgaaggaaaagtcacaactgaagagactggaaattgtggaaatggtcagctttttttccctgattttgttctactgtggtccttacgtggccttcattcaatacctaggcttcatggtgggcttagctttccccttccaagtgactcacaggcaactccagatctagtgttctattattagccttctcaaacctgattattctaagaagcacttcccactggcaacatggtaatcatgtttaaatataactcttcatgatcaatctaaatctccagatttttaaccaagtttccctgtggcttagataccttttttttttgctttgtttttaattaatccacgtttttataatcctatgtgacattaacatgtaaggggtgtgtgtgtctgtacgtgtggccttctgcactaaggcattagacagaaacaatttgaatgaagaccactggctcttctagtcaaacttcctctttctgtatactctgcctgtatctgtcatctgtctatacctgtcagatgtctgtacatgtcaggaataaagctaacgggatgtataacaactaataattcatggtttgaataactatagtagctttcatttattgaatgtttcctacgtaccaatgatatgggctggctgtgtccccacccaaatctcacgttgaattgtaataatccccacgtgtcaagggcagggccatgtgtagataattgaatcatgggggtggtttcccccatactgttctcatagtagtgaacaagtctcatgagatctgatggttttataaatgggagttccccaacacatgtcctcttgtctgccaccatgtaagatgtatcttgcttcccctttgccttctgccatgattgtgaggcctccctagccatttggaactgtgagtccattaaacctctttcatttataaattacccagtcttgggtatgtctttattagcagtgtgagaacagactaatacaaccaggaaccaggaaatatgcatgtccttactttatttttgtatcaatcctatgaggtagggacttttattttcttcattttatcaataaagctcaggtagggtaatttggcctagattacatcagtaagtgaagagaacaaggtttcagcttaatcctgtcaatctggccatagcctatatacttaggctatacaaatattaaagtatactattaagttacaaaatattaatattaaaaactaagaatggtttctatatcctctacaacccaattttccaatctttcagtaaccagggcaatgagactgaaattgttcattttctgtttttatagacatttctgttttttaaaacaagttgttagcatcaaatttcggtctctgtgaatctggaaacacaaggctatagctgacctgtcagttattatattatttgtttttgcaattttggccacaggccatttatcctatttcatgtttgttgctttttttttttttgagatagatagggtctcactctgtcacccagactggaatgtcatggcacgatcatagctcactgcagctttgaactcctgggctctagtaatcctcccacttcagcccttcaagtagctgggattacaggtgtgcgctaccatgcctggctaagttttctattttttgtagagacgaggtctcgctatgttgtccaggctggtcttgaactcctggcctgaagcaattcttctgccttagcctccaaagcactggaattataggtgttagccactgcacccagccttgtagcttctgaagagcaggaaggagagcttgtgagttaatatgaaacattaagatgtcaatatcatgaaataaaggcatacttttcatagcaaacctttccataaattactcttacgctttttctttctttattcctcttgaactgtaataaaaatgaaaactataacaaatataatcacttttaaatgtttcttagtcctaagcttctatcctgttgctttccagtaatgtgtttgtggttgctgttgtaactataacaccttaactttcaatgatctaattttcacagtaaacagttaccctattttccaaagatcacactctgacaatagaagttaggacatatctatatgcatacccatatttgggaaatagattaatcaactaacacagttttccaaataagtaattttttaaaaatccctttttttccattttgttaagccttttgtattttctttttgatattaggtattgacatgaccctgcctgcacagttccagtgataaacacttgctttaatgatttattgcctttcctggaaaggaacaatgaatgatctgaacttattgctgttcctatgcttggtgggcaaatcacattgagtttgccttcatggtcaatacagatggctgtaatcaaatcaattttgggacaagccacattgaatgctaaaagcctgatttgaatagcacagcctaaagatgatggaacctatgccactgccagctgattactatgctttagaaaaataaaaatgttttaattaattacggggatgacaaaaatctgtattaaaaggagtaaaattggaaatctaatcaagggtattaaaatccccaacgaattaggcctgaaggaaggatatctaaaagatgtaccaatgagttcatacagacctacagatacatctaatgaatggttgctaaataggacaaatatagctcattatcattttagaaggataattatagataattacaggtaaactatcatcccaatgctacatgtgatgtagatgacatgttatgctgggctttttgttttctctcacaacacttattgaatatccactaagtttagaacatcacagaagttcagatttgtaaataagaaaaaaaaaacaacacagaaaacatagaccaaagcccattataataaactccatggagcatctacatttttgcttgcagtacaattttgtttacatatttacaaatcactttcctatcaacagggaactagagactaataaaagggctcatgcccaactgttctggagaatttaagcaagtaaaatgttgtgttcaaaatgcagtaggggtaagaggtggataaaatgcatataacttcacttttgcttattctttctatggttcagccttgatctggtttggtgcacaaatgtgaaggtttagaggcatactttggctgtgcagtttaggtagtattttgatgcacatgtaaaggctagaaaaaaatttaaaagtgctatttggtgactagatgtattcggtttcagaactaataggctatatagagatataaaagaggatatttattatgggaattggctcacatgattatggaggctgagaagtcccatgaggtgccaccagcaagctggagaaccaggaaagctggtgtgtacttcagcctgagtccgaatctctgagaaccggggagccaatggtgtaagtccgagagtccaaaggcccaagaaccaggagctctgatgtccaagggcaggagaagatggatgtcccagctcaagaagagagcaaattagcccttccttcaccttttcattctatctgggctctcaacagattaagtgatgcccatccacactggtgagggcagattgtctttactcagtgtactgattcaaatgttaatctcttccaaaaggacccacatagacatacacagaaatgtttaccagctctctgggatctcttggccctgtcgagttgacataaaattaaccattacaccagaggaaaaaagaaaaaaactttgacaaactaagttatctttttaatacatgggtagaattaccactcacacagtaaagaaacaaagagctgttgaacagatataatgtattataatgcatttagtggaccattttagaatatagaaatggagtaaagggaaaaatctgtgatcaaaagaattttaccactcattcattcattcaaaatacatttatgtattaaatgtacataatagatttactcattcactggttcattcaaaaacattcagtatatgctatgaaccaggcactgagtgagccaatagacttggtttcccaaagtcagaaaaagatgaactcttaggaaaaaatacacaaaaatgaaaaacataaccataaaatcatcaggaaatagcaaaatttataaacataattacagctattaaataatacttgtataaaaaagtacacagtgttatataaaaaaaggcataaagcaacggtaaggcattggagagattggggtcaaatgaggttagtctttgaaaaggtcaaccaggagactgcatttaaaagcgggaaaaggatataatttgttcaagtgaagtgggaatggtgtatcaggaaggccaagcaattctaggtgggagaagtgtgtacagtagaaggttttcttagcagaaacacagaaaacaggtgtgggaaatatcaccagttcttaacttggcctgtctctctattaagaagagggtcacaaagtgttcacagatggagatattctctttccaatgggataacagtactgatttagttcatatgaaaagattttttacatgaaaatcatattttttggaataaatgatgtgcaattatgtacatgacaaaagaattgatttacaggggaattttgccgcagtgttatccaaacactaaattttttccatatatttaaaacatgatgctatttactaaaacatgctttatgcactctcctcccaggaacacatgcattacacaaaagaatgtatccatttgccttaaaacaaaacaacagtagcattaccatttcattttatttagctactaatgtcaagagagctcaatgaaaggaaatgttttttcagagttgaaaaaactctgattccccttgaaaatagtcatccaaggtcaatagagatcatgttattcagatttttagacaagaaacgaatgggggattcagatgacattgtgcttcagtgatatgttaggcacatgaattattatagtggcttgaaagagaaaaattcatctaagaatcttcctaattcccctttattcactgactttctcagtatcatctatcaaatatttcaaacaaaaaggaccacattgttaagtgacataaagaataaaatttggcagcacagatttggcttttcctctcttatgcaagtataaagttatgaatacaaacaaatttagttttcacttgcttttcatcatctaatcaataaaacacattctacataatccaaagcatactgaaagtagagatgacattaaaaagctgactataaaactaaatttcaaaagagcttaaaatctagtgccatgagaagtccagaagattagttattatgttctttaggctaattgagttcaaatgttggcttttatgaaatgtgcacaagggccacctcatgattaagtaatcttagcaaacgcacacaccggtcagaatagtcacatctgaacaaaaggcacataatacttatatgtggcaatacagcaacctctaagacagccatgtgattagaaatgtacacagcagtactgctgacctaaaaaattacatttgttacatggggaaggtgtatatattattggaagtcatggacttgccttacaaatctaaatttataaacacatcatagatgaaatgcaagtttggtcagtaaattggccatctgttccagatacttacttttctgtttcaaggagaaaaacagtctattctaaatattttcttagtcaacctcccatttgaggctctagtgaccaatcaatccatcaatcatttatgtatatctatctacttaaaacaaatatttattgaggttgtactatgccccaacactgttctaaactctggggtttcagtggtgaatcagaaaaggtgcctgtacacatcctagagaggtagacaaatttaaaaaaaatcaaacaataaatatttcagtattgataaattgtataaagaaaaataaggcaaagtagaagaacacagagactattttatcttattttatttttacgtatttcaatagttttgggggaacaggtggtgtttggttacatggataagttcttcagtggtgatttctgagattttggtgcacccattacccaaggagggtacactgtactcaatgtgtagtcttttatccctcacccacctcactcttccccacaagtccccagaattcattatatcattcttatgcatttgcatcttcatagcttagctcccacatataagtgagaacatatgatgtttgattttccattcctgagttacttcatttagaataatggtctccgactccatctaggttgctgagaatgccattatttcattcctttttatggccgagcagtattccatggtattctttatccactcattggctgatgggtatttaggttggttccatatttttgtgattgcgaattgtgctgctataaacatgcatgtgcaagtgtccttttcatataatgacttctttttcactagatagatacccagtagtgggattgctggatcaaatggtcgttctacttttagttctttaaggagtctccatactgttttcggtagtggttgtactagtttacattcccaccagcagtgtagaagtgttcccttttcaccacatccatgccaacatctattattttttgattttttaaaattatgaccattcttgcaggagactgttttaaatagagggacctgggagggtcttcttaacgcggtagttcacatttgagcagaaggttctcgttctctagtctattatattttcttataatttaaaattgtgcactctttgtgcagtgctgattcttggctttcctttcccccttctaccgttttcttttactagcttttgcctctcagagagcgtgagttaggaggtgaaactcatttatttgtgacaatgttgttcctgctgacagctttacaaagagttttgattgaaaagaaggctgaaaataagggataaaatgagatattcttggattctaatgatgcacattttctctgccaccctgaactcatatatcagtaaacaattgagaattgcctagctttctgagtgatctctgtttatcataggctctgggaatatgtctgatggtgatctcttataatacattaaataatatattttagtagtccattgtaatttgttcatctctgaatttggtaggaagtcatcctgatctttagcaatgaatgtgtactttgagattcccttgaattcataaaaaaaggttaatgtatccatattagtctgttttgcattgctatgaaggaatacctgagactgggtaatttataaggaaaagaggcttattggctcatggttttgcagactatacaggaatcatggcaccagcatttgcttccagtgaggcctcaggaagcttacaatcatagcagaaggccaagggcggtggggggcaggtgtatcacatggtgtgagagggagcaagagagagagagatgggggaggtcctaaattctttttaacaatcagttctcacatgaagtcattactgtggggagggtaccaagccattcatgagggatctacccccatgaacccaacacctcccaccaggccccatctccaacattggggaacacatttcaacatgagatttggaggggtcaaacatccaaactatatcagtacctattttacaaattgtatatttctgctgatatcaatttaaataaaattacattatttcataattatctgactcatgtcaggaattatcactaaattgatgacaaaagctttggacagtagaacaatctcaaaatattgtttccctagcataatgatgctgtctagcaataggatagaggattgtgggaatattttagctctgaaaaaagtggttctttacagttacaaggacagagaaaaactcaatatttctagaaaggaatataaagattcttactctcagaatccctggaaatacaaatataacaagaaatcttgtttcatcaaaattcttgtgaagttactgcagctaaaatcaggagtcaaataggggattctctctatacatagcaatggtcaagaaagcttgaataaccacagaaaggagcctagaatcaaagaagcccagggtaggaaggcatctttaaaatcacctggttctatacttcattaaaggcttgaatcatccagcaacttctctgccatacaatattcagactccagtaatggagaacccatttctttctaaagcagtgaactcctttaatggaaacctacataaatggtaaaatgtcctcccttgttgaactgaaatctattttttctttaacttccatttccataacagaaatttaactacactttgggggatgctttttactttcataaagcattttgactatgcacaagaatttgaactccaggggttttctggacctataatttagattttgggaggatatggtgggggcaaggcaggaagaaaagaaggtcttagtgttgtgcttcaatccagaaattcctgaagttcatcaccaacagttattggaggagttgttaataaagtaatttttaaatgttcactgttattgtttcttgtgtactgctccctcagcaacctcacaaggtgcaagtggggtaggggatgactgagaaggaagcattcagccattcctgggtctctagacccgatgccatcaaatactagtaaatctctgttgtaacccctagcaaagactttactaggcaggtttttccatcactgaacaagctgaatatttagaaagtgttttcttgtgtgtctccctacccccacccccataactttcaccactgaatcctttactagataagcaacacataagggtatttggagcccttcatgtaattgaatagggggatagtttctgatgatggttttacatgacagatggtttctagattatccaggtttttatcaactggatgctgtctagcatatcaaagacattttaaaacttttaaataaatatgtgctaagcaggtccaaagaggctaccacttctggtgatctggtcactgtccttttcccaatgcagtataattttatgagcactttgttaaagctgcatctctttgcaaaccagcttggttaaatttcctatttcattttcacatatctagtgttcattttcacatatctagtgatctgttcttatacagttgatttttttaacctcaaggaaggattttatatttatccttagtaaatttcattctaatggtttttatctagtgttatagcctctggagatcatgctgcatcttgattttgtcatcagtcagttaagccattactccactcccaggtttgtagcatccacaactttggaaagtacaatgtaatggtccttgtcgtccctggctctgccttcttctaacttttgcacttaaggtcaattaaaatgcatgaattcaaaatagtttttccttccaggatcaactctgcttattagactgaaggtggggacagaatgaatttagaatcattttattttagcacaggaaaaactgtataattgtgattgttggattcttcaggattgcatgatataatatttcaaatggcctctaatttctttaagtctcttttcagggaggaaaatccaggtttatatgcaaaaatgtagccagtatgcatatctgacaaaaactcgacaagtaggaatgaaagcagtgtagaccaaggaaaatggcttgacactggaatagagaaagggtgaataatctggagtcaaacaaaggtcccaagagagtgggtgaaactctccctgaatcttgagttcaaactatatataaaggtttgcaggaaaagaaacagaaaaaggcagtgaacaggcagtcctggagagcctggacaaagaaaaagattataataagagaaagacacttccttgtcattttatgggaaaatgagaaggaagaggcaaagaagtttgtgtgtgtgcatgagagataggggagggagttgggtagtgagagttgtggtggaaaaacacctgctttgtgctttttgattctttctggagcttagctcaactgaatgtcttttttttttttctttcaagaattgacatgctgatataagagctcaaaaaccagcaatttctaatgaggtttgctacatcaaatgtgatctaggccaaccttttttatttagctgtagtggaaaaaacaattctccaaaggctaattcttgctggaggtcacacagccaatttgtttcagagttgagactagagaatccatgtctcccaatcactggttcagtagtcttttctatggaggactccctcgactaatagttcaaacaacacaacatcaaataagccttgttctctatcaacctgatctatcttctgctgatagctgattaaacaaacgattatagcaacaaatgaatgattgtgactcgtttaactatatctggacctggaggtagctatttgtttttatattaggttttaaaaaatggatttaaatattataattctatagaaattatagagaacaagaatcagagcaatcactacatagctctatgaatttgctgcagagaattaagacataacatatcagatacatttgaagcaccctatgtattactttgtaatctatttctcatacttcttctttaaatgtgttgattatcatcttccatgaattaggttggtaaagaagttgacaaggggctttatatttttaaaatagagaaaatactgcaatataatatttgattacacgaataggggctggtacacaaatgtttgtccttcaatttccatttatgaatggatttgcttctaggctgtcttttccatgtcattatcatttgtctatttctgtattaattccacatcatcttaattactaatagtttcataagatttgatagctgacaaagcaagttctcccatattttcaagctaattttggctccttgtttttcctcattaattttagaatatgcttgttaagatccaaaaaaaactttgttgaaatatgataatggttttatactgtaaattgagagatgaataacatctctatgatattaagtcaagccattttggatatggtctatggtatcatttgtttccatttttatatccttcaaaactgttctgtatttttttccacaaatgtctttcacacattttattagatttgtgcctaggtaatttatagatttattgttattatgtaggaagaatactatatttgtataatatatatagtatatatgtatactatatataacatatatgttacctgtgtactatatataacatatatataacatatacactgtatgtaatagatgtgtatactacaggtatttacaaatactatcagttttcatgtattaatcctacagctaggaacctggctaaactccctaatagtttgtagttacttttaggttttctatggttgcaaccttgtaaatcccatgtaatttcagtttatgttttccttttcaaccattatgccttgtatttctttttcttacctcattgcattggccaggttgccattatattttaaataagagcagttatgttttagatagataatttttgtcaatttaaaaatttatcttccatttattgtttgctaatttggtttatttttcaattttatgagtgtggaattttatcaaatatatcttaagctcctactgagttaatgttatgtttttttccctttaatctgttgtcattaatagttttccacatattgaaacactcttatattttcattaatttttattgccctataaaatctgatattatcagctgaaagtcatgcttgccaaggattttcaaggttaaaaatcactaagtgtgagtcttgtctttaggaatcaagtggtgcatcttaatggatgtgtatgtgcacatatgtatacacattaatttagataaacacacatacatctagtcacacataaatacataaatatacatgcatataaaataaaatataaataatggtgcttatactttgtccattttatttcaggacaatcactgaagttttcattgttgaatactaacaaccttttgtaatagccatatattacaattggtgtagcaatgagaacaaaataaagtgaagctctacagaattttaaataagcctaagcagtactacaaacagcattcattttggctaaacactatgatgtcctcttaagaacattacttaaagattttaaagctcattttctctttagtaatcacgagtttggagtgaagtggcaatgtagggaataaaaagaacttactataaatggtatttgaaaattccttatgtggatccacatagtgttgctaggaaacatggtttcttagcatttggaaagctagaaaaccaagtttcttacctcttttggccacagaaatctgtatcatggatctgatttaagagagtttggagattagttggcttcaaaatattcggataagcataaattatgttttatgaccaaccatcccttaagaaataataacatgttttcaactcatgctcaaaaataggaaaatataccctgtatcatctttcattactgggatatcacataactgaaatattagaatagtggttaaaactatagtgatgattaattttacatgtcagcttaactgggccacagggtgtcctgatatttgatcaaacatgatggatgtttatgtgagggtatttctgaatgagattaatgtttgaattggtagattacttaaagcagcctgtcctccctaatgtttgtgcctcatgtcatcagctgaagtcctgaatagaacaaaaggctgtccctctttctattagcgaggattcttcctacttgactaccttcggattgagacattagctcttttcctgctttcagactcaaactgaaacgttggctgtttctgggtcccaggcttgcttaccttaggacaggaactacatcactggctctcacggttttcaggccttcacactcaggctgggaccaaaccatcagctagctatcctgggtctccagcttgccgagtcaccctatagatcttgggagttgcctgcttccataatcatgtgagccaattccttacaataaatctatctatctgtctgtctacatcctattgtttctatttctttggagaatcctgactaatacaaatataaactctatagccagattggttaggtttgaattacagctttgtcacttactgcctatgtgactctcagcaagttatttaaaatctctgtgcctcattttcctcacctttaaaacagggaaaacaatagcacctgcctaatggaactttgtgagaattaaatgagctattacatataagacacttagtaggacgcctgaccataataaatgttggataaatgttacctattattactgtgtggttgctgttgtcattcttgtattagaaaatgtattttcaggtggaactattacaaatttcaccatttcttacactcttaagacttcttaagcaaatagaatttactcttgccaatattaatctagagatggatagcccagtgagaaatttacattctcctgctaaatgggtttcctataacattgccagaaacccagcaagttgaaaaaaatatacagaaaaagaaagaaacaaatgtagactctgtgggtgagtgggtgcatccatggaattaaagagaaagggggacagtttaaatggaacgctggatgtatgtcttaagtgcatttgtatcaaaagaagggcatatatatgaaggtataaaatgtaatttcttcagcttcataaaaaccttctgggtatgaagagagattgatgaaacaagtatcaatatagaagtaaacaccatcagaattcagaactggaagtgaagaacaattctgtatgcaaattgaaaccaccagagggaacctaggtaggtggaatataattacccaaactggaaagtgcccaggaagctggattaataatctacattttaaagaagtgccaggcatttttgaagtcaaaaatgttcagaaacttttgattatgttttataatcacaaaatattttgaaagtacattcaatgtactagttggaaccataccaaaaataagagctcagtgagaaggaaagaggaatgtggtgctttttattgttatatatatttcatctttttatagtattgaggaggcttatatttaaatagaatgacagaaatgaattattccctcttgacgggtgcaaaatcttagagcattatttttctctcaaagcaaactataggattcaattccccattacaaggaaaaatgaaaaaagtatgatagcgagttttattagagagtgtactcgaagcatttggagaaattttagaaagagattgtcacaatagcatcgaaataaatcttaggaatgatttctacagtttgtaggcagaaagctatctaggttaaacgagtcatttcttcagccattagatctgcccttctgtaatagctgcacagttttgcacaaagggctatatgttagggccagcaaccaggagtcttgattttaaaagaaatgatgtcggaagtgctggctaattaacaaaaggcattggcaacatttacggacttataagcagtgaataacattgttcttttcattttatcatatgaaagtgttcacataactattatctgctatccttgaatggtgaggtgggaacaagaagacctatacagtatctgcataggaagtggtgaaataaatgtttacttgttttaaacagtctctttttagaagatcagtgtgttctttacagttacagtgagaactgtaagtctgcttgtctgacttttcgtgaaatgctcttccaaaatgacgacatagaccaagtatatattcctaaaacctgtgccaagcagctttcctatcttgtattagcattgagttaactagcaacatcataaaatagatggaagaataaagattaacctaatgaatcaatgaataggtaaatatttttaccacagacaagtcaagggtaagggtatttatgaccctctatataagaccatctttctcatccgtgacatggaacaggcatagaatgttggctttgtgttaagagggaaatttatagcattaaatgcccacattagaaagctagaaagatctcaaatcgataccctaacatcacaattaaaagagctagagaagcaagagtaaattaatccaaaaactagcagaagacaagaaataactaagatgagagcagaactgaaggagatggaaacatgaaaaaccctccaaaaaatcaatgaatccaggagatggttttttgaaaaaattaacaaaatagatagactgctaactagactaataaggaagaaaaaagagaagaatcaaatagacacaataaaaaatgataaaggggatatcaccactgaccccacagaaatacaagctactatcagagaatgttataaacaactatatgcaaataaactagaaaatctagaagaaatgaatagattcctggacacatacatcctcccagaaaccaggatgatatcgtatccctgaatagaccaataacagtttgaaattgaggcagtaatagcctatcaactaaaaaataaaagtccaggatcagacagattcacagctgaattctaccagaagtacaaagaggagctggtaccaaaccttctgaaactattccaaacaactgaaaaggagggaatcttccctaactcattttacgaagccagcatcatcctgataccaaaaccgggcagagacacaacaacaacaaaaaacttcaggccaacatccctgatgaagatcaatgcaaaaatcctcaataaaatactggcaaaccgaatccagcagcacatcaaaaagcttagccaccacgatcaaatcagcttccttcctgggttgcaaggttggttcaacatacgcaaatcaataaatgtaatccatcacataaacagaaccaatgacaaaaaccacatgattatctcagtaggtgcagaaaaggcctttgataaaattcaacatcccttcatgttcaaaactctcaataaactaggtattgatggaacacatctcaaaataataagagctatttatgacaaacccacagccaatatcatattgaatgggcaaaagctggaagcattcccttcgaaaactggtacaagacaaggatgccctttctcaccactcctattcaacatagtattggaagttctggctagggcaatcaggcaagagaaagaaacaaagggccttcaaataggaagagaggaagtcaaattgtctctgtttgcagatgacatgactatatacttataaaatcctatcatctcacccaaaaactccttaagctgataagcaacttcagcaaagtctcaggatacaaaatcaacgtgcaaaaatcacaagcattcctatacaccaacaatagacaagcagagagccaaataatgaatgaactcccattcacaattgctacaaagaaaacaaaacacctaggaatacagctaacaagggatgtgaaggacctcttcaaggagaactacacaccactgctcaaggaaataagagaggacacaaacaaaaggaagaacattccatcctcatggataggaaaaatcaatattgtgaaaatggccatactgcccaaactaatttatagattcaatgccattcccatcaaactaacatcgacattcttcacagaattagaaaaaactactttaaatttcatatggaatcaaagaagaccccatatatccaagaaaatcctaagcaaaaagaacaaagctggagtcatcatgctacctgactttgaactatactacaaggctacagtaaccaaaagagcatggtactggtaccaaaacagacacatagaccaatggaacagaacagatacctcagtaataacaccacacatctacaaccatctgatctttgacaagcctgacaaaaaaaagcaatagggaaatgatttcctattcaataaatggtggtgggaaaactggctagccatatgcagaaaactgaaatcggaacccttccttataccttttataaaaattaactcaagatggattaaagacttaaacgtaaaccccaaaaccctaaaaaccctagaagaaaacctaggcaataccattcaggacataggcatgggcaaagatttcatgacaaaaacaccaaaagcaattgcgacaaaagcaaaaactgacaaatacgatctaattaaagagcttctgcacagcaaaagaaactaccattggctgggcgtggtggctcacacctgtaatcccagcactttaggaggctgaggcgggtggatcatgaggtcaagagatcaagaccatcctggccaacatggtgaaaccccctctctactaaaaacacaaaaattagctgggcgtggtggtgcatgcctgtagtcccagctactcaggaggctgaaacagaattgcttgaacctgggaggcagaggttgcagtgagccgagattgtgccactgcactccagcctagtgacagtgtgagacttcatctcaaaaaaaaaaaaaacaaaaaacctatcagagcaaacaggcaacttacaaaacggaaaaaattttttacaatctacctatctaacaaaggtctaatatgcaaaagttaaaggaacttaaacaaatctacaagaaaaaaacaaccccatcaaaaagtgggaaaacgattatgaacagacagtgctcaaaagaagacatttatgcagccaacaaacatatgaagaaaagctcaacatcactgatcattagagaaatgcaaatcaaaaccacaatgagataccatctcacaccaatcagaatggtaattattatttttttctataagttttattaatatttgaatataattcacataacataaaattcatccttttaaagtatgccatttggtgattttttgtatattcagaaagtcatgcaagcacaaccactatctaatttttttttattatactttaagttctagggtacatgtgcacaacgtgcaggtttgttacataggtatacatgtgccatgttggtgtgctgcactcattaactcatcatttacattaggtatatctcctaatgctatccctcccctctccccccaccccatgacaggccccggtgtgtgatgttcctcactctgtgtccaagtgttctcattgttcaactcccacctatgaatgagaacatgtggtgtttggttttctgtccttgcaatactttgctcagaatgatagtttccagcttcaaccatgtccctacaaaggacatgaactcatcattttttatggctgcacagtattccatggtgtatatgtgccacattttctttattcagtctatcattgatggacattggggttggttccaagtctttactattatgaatagtgccacaataaacatacgtgtgcatgtgtctttatagcagcatgatttataatcatttcggtatatacccagtaatgggattgctgggtcaaatggtatttctagttctagatccttgaggaattgccacactgttttccacaatgggtgaactagtttacagtcccaccaacagtgtgaaagtgttcctgtttctccacatcctctccagcacctgttgtttcctgactttttaatgatcgccattttaactggtgtgagatggtatctagttgtggttttgatttgcatttctctgatacccagtgatgataagcattttttcatgtgtctgttgggggcataaatgctttcttttgagaagtgtctgttcatatcctttgaccactttttgatggggttgtttgattttttcttgtaaatttttaagttctttgtagattctggatattagccctttgtcagatgagtaggttgtaaaaatgttctccctttttgtaggtttcctgttcactctgatggtagtttcttttgctgtgcagaagctctttagtttaattagatcccatttgtcaattttggcttttgttgccattgcttttggtgttttagtcatgaagtccttgcccatgcctatggcctgaatggtattgcctaggttttctttaagggtttttatggttttaggtctaacatttaagtctttaatctatcttgaattaatttttgtataaggtgtaaggaaggaatccagtttcagctttctacatgtggctagccagttttcccagcaccatttattaaatagggaatcctttccccatttcttgtttttgtcaggtttgtgaaagatcagatggttgtagatgtgtggtgttatttctgaggactctgctctgttccattggtctgtgtgtgttttggtaccagtaccatgctgttttggttactgtagccttgtagtataatttgaagtcaggtagcgtgatgcctccaggtttgttctttttgcttaggattgtcttggcaatgtgggctcttttttggttccatatgaactttaaagtagttttttccaattctgtgaagaaagtcattggtagcttgatgggaatggcattgaatctataaattatcctgggcagtatggccattttcacgatattgattcttcctatctgtgagcatggaatgttcttccatttgtatcctcttttatttcattgagcagtggtttgtagttctccttgaagaggtccttcatgttccttgtaagttggattcctaggtattttattctctttgaagcaattgtgaatgggagttcactcatgatttggctctctgtttgtctgtgattggtgtataggaatgctgtgatttttgcacattgattttgtatcttgggagtttgctgaagttgcttatcagcttaaggagattttgggctgagacaatggggttttctaaatatacaatcatggcatctgcaaacaggggcaatatgacttcctcttttcctaattgaataccctttatttctttctcctgcctgatttgccctggccagaacttccaacactatgttgaataggagtggtgagagagggcatctctgtcttgtgccagttttcaaagggaatgcttccaatttttgtccattcagtatgatattggctgtgggtttgtcataaatagctcttattattttgagatatgttccatcaatacctagtttattgagagtttttagcatgaagcgttgttgaattttgtcaaaggccttttctgcatctattgagataatcatgtggtttttgtctttggttctgtttatatgacggattaagtttattgatttgcatatgttgaaccagccttgcatcctagggatgaagcccacttgatcgtggtggataagatttttgatgtgctgctggatttggtttgccagtattttattgaggatttttacatcattgttcatcaggaatattggtctaaaattctcttttattgttgtgtctctgccaggctttggtatcaggatgatgctgtcctcataaaatgagttagggaggattccctctttttctattgaatggaatagtttcagaaggaatggtaccagctcctctttgtatctctggtagaattcagctgtggatctgtctagtcctggactttttttggttggtaggctattaattattgcctcaacttcaaagcctgtaattggtctattcagggattcaacttcttcctggtttagtcttgggagggtgtatgtgttcaggaatttattcatttcttctagattttctagtttatttgtgtagaggtgtttatagtgttctttgagggtagtttgtatgtatttctgtgggaccagtggtgatatcccctttatcatttttttattgtgtctatttgattcttctctcttttctccattattagtcttgctagtggtctattaattttgttgatcttttcaaaaaaccagctcctggattcattgattttttgaaggtttttttatgtctctatctccttcagttcttctctgatcttagttatttcttgccttctgctagctttttaatgtgtttgttcttgcttctctagttcttttaattgtgatgttagcgtgtcaattttagatctttcctgctttctccggtgggcatttagtgctataaatttccctctacacattgctttaaatgtgtcccagagattctggtgtgttgtgtctttgttttcattggtttcaaagaacatctttatttctgccttcatttcgttatgtacccagtagtcattcaggagcaggttgttcagtttccatgtagttgagcggttttgagtgagtttcttaatcttgagttctagtttgattgcactgtggtctgagagatggtttgttataagttctctgttcttttacacttgctgaggagtgctttacttccaactatgtggtcaattttggaataagtgtgatgtggtgctaagaagaatgtatattctcttgatttggggtggagagttctgtagatgtctgttaggtccacttggtgcagagctgagttcaattcctggatatccttgttaactttctgtcttgttgatctgtctaatgttgacagtggggggttgtctcccattattattgtgtaggagtctaagtctctttgtaggtctctaagggcttgctttatgaatctgggtactcctgtattgggtgcatatatatttaggatagttagctcttcttgttgaattgatccctttaccattatgaaatggctttctttgtctcttttgatctttgttggtttaaagtctgttttatcagagactaggactgcaacccctgcttttttgtttgtttgttttccatttgcttggtagatcttcctccatccctttattttgagcctatgtgtgtctctgcacgtgagatgggtttcctgaatacagcacactgatggttcttgagtctttatccaatttgccagtctgtgtcttttaattggagcatttagcccatttacatttaaagttaatattgttatgtgtgaatttgaccatgtcactatgatgttagctggttattttgctagttgttagtttgtttgttagttgatgcactttcttcctagcatcgatggtctttacaatttggcacatttttgcagtggctggtaccggttgttcctttccatgtttagtgcttccttcaggagctcctgtaaagcaggcctagtggtgacaaagtctctcagcatttgtttgtctgtaaaggattttatttatccttcacttatgaaggttagtttggctggatatgaaattctgggttgaaagttcttttctttaagaatgttgaatattggcccccactctcttctggcttgtagagcttctgctgagagatccactcttagtctgatcggcttccctttgtgggtaacctgccctttctctctggctgcccttaatattttttccttcatttcaattttggtgaatctgacaattatgtgtcttgaagttgctcttcttgaggaatatctttgtggcattctctgtatctcctgaatttgaatgttggcctgccttgctaggttggggaagttctcctggataatatctcgcagagtgttttccaacttggttctgttctccccgtcactttctggtacaacaatcagatgtagatttggtcttttcacatagtcccatactttttggaggctttgttcatttctttttaatctttttcctctaaacttctcttctcgcttcatttcattcatttgatcttcaatcactgataccctttcttccacttgatcgaatcggctactgaagcttgtgcatgcatcatgtagttctcgtggcatggttttcagctccatccggtcatttaaggtcttctctacactgtttatcctagttagccattcgtctaatcttttttcaaggtttttagcttctttgcaaagggtgtgaacatcttcctttagcacagagaggtttgttattactgatcatctgaagccttcttctctcaactcatcaaagtcattttccgttcagctttgttctgttgctggcaaggagctgtgttcctttggaggagaagaggtgctctgatttttagaattttcaacttttgtgctctggtttctccccatctttgtggttttatctacctttggtctttgatgatagtgatgtgcagatggggttttggtgtggatgtcctttctgtttgttagttttccttctaacagtcatgaccctggaaatgctgcaggtctgttggagtttgctggaggtccactccagaccctgtttgcctgagtatccccagcggaggctgcagaacagcaaatattgcagaacggcacatgttgctgcctgatacttcctctggaagcttcatctcagagggacacccggttgtatgaggtgtcagttggcccctactgggaggtgtctcccagttaggctactcaggggtcagggacccacttgaggaggcagtctgtcctttctccgatttcaaactctgtgctgggagaaccactactctcttcaaagctgtcagacagggaggtttaactctgcagaagtttctgctgccttttgttcagctatgccctgcccccagaggtggagtccacagaggcaggcaggccaccttgagctgcagtgggctccacccagttcaagcttcccagccactttgtttacctactcaagcctcggcaatggcggacgcccctcccccagcctcgctgccgccttgcagttcaatctcagactgctgtgctagcagtgagtgaggctccatgggcatgggaccctccgagccaagtgccggatataatctactggtgtgctgtttgctaagaccgttggaaatgcgcagtattagggtgggagtgtcctgattttccaggtaccatctgtcatggcttcccttggctaggaaagggaattccccaaccccttgcacttcctgggtaaggcgatgccccgccctgctctgtgggctgcacccactgtccgacaaaccccactgagatgaacccagtgcctcagatggaaatgcagaaatcacctgtcttctgcatcactcacactgggagctgtagactggagctcttcctattcggccatcttgggaccatccagaatggtaattattaaaaagtcaagaaagaatagatgctggtgaggctgtggagaaataggaatgcttttacactgttggtgggaatgtaaatgagttcaaccattgtggaagacagtatggtgattcctcaaagatctagaagcagaaataccatctgtcccagcaatcccattactgggcatatacccaaaggaaaataaatcattctactataaagacaaatgcacacgtatgtttattgcagcactatttacaatagctaagtcatggaaccaacccaaatgcccatcaatgttagactggataagaaaatgtggtacatatataccatggaatactatgcagccataaaaaaatgagactatgtccttagcagggacatggatgaagctggaagccatcatcctcagtaaactaacacaggaacagaaaaccaaacactgtatgttctcactcataaggggtagttgtataatgagaacacatggacacaggggggtgaacaacacacaccaatgcctgttgtggggtggggaatgaggggagtgaacttagaagatgggtcaataggtgcagcaaaccaccatgacacacgtatactcatgtaacaaacctgcacactctgtatatgtatcctggaacttaaagtaaaaaaaaaaaaaaaagaaaaagaaaaaaatctcagtacaaaagatatgtctcatacaggaacaaaaacaaaacaaaacaaaaaacaatattggctttgtatctccacctgcctgcatctacttttaccactgaatacctcgctattccatgctatgagaaccctatgattcagttatatcaaatgatttgccatgctctgaagtcacccaactttcacttttcatatttgcctttcttcagtgatatggtttggctgtgtccccatccaaatctcatcttgaattgtagctcccagaagtcctacatgtgggagagacccagtggaagataactgaatcatggaggaagttttccccgtaccgttctcacggtagtgagtaagtctcacaagatatgatggttttataaggggtttccctttttgcttggttcttattctctcttgcctgccaccatgtaacatgtgtctttcacctcctgccatgattgtgaggccccctggtcatgtggaactgtgagtccactaaacccctttttctttataaattacccagtctcgggtatgtctttatcagtagtgtgagaatgaactaatacactcagcttgagttgctcttcctttatattatcctccaaaaagtttctacttatcctgtaaggttcaactgaagggtcagcatactgatatatcctcttttaacttctggacagagttgtgtatctgttctattatgcttcatttgagccctacctatttctatcacagcaagtgtcactgaactgtgaatatccacttccattacaacggagttccttgagtgaaaaatacataatacctatgagtaattaatttctgcatggcattcatgcagccatattcattttatgtgcatcattttactatcaagagttaaaattaatggtcagtgattttcatttcttgcaattttacttccttagccagcataggttcctggcatcatttcttctcaaccccaacagaggctcaattccagtactgactggaatgcttttcatgcatgaagaatattgaaaagagctctttcttactttcatgtcttatttaaacatgttacttgctttattttttaacctttaatgactatcacttgccttatttgtcacatttggactaaataatcatttcattttgtcagccagtgttaattcttatggcttgttattgaaactaagcaaattcaatgtatagcatgagtaagatgggacagagaaaaagggaactctgaagaaagtgagctattgactgtgtccctacaaaagtagagatcaatatgtaggtaagaggtaggaaggaaggctgagaagaacagactagaaaggcagtgaagtgagactcaagcgatttaaattctcatcttgcttcactttcaacttcttgtataatattttttttcctctttgggcctcatttatctcatttgttttttgagggcgatgtacttaagtcttttgtatagcaccagtatgattttgcaatatccacacataattgtattagtatttgcttaaataaaaattaaactagtgctcttaactttatgccattcccacaataatcataagcaatgatatctatataataaaccaagttaatgagctatttatttttgtgtgtacattaattacatggacattaattttttaagtccatcctatacacctaaaataacaacagctgacatttatctaaattttgctgggtgccatgtgctgttctaagctatttatttgtatttactcatataatcttcacaacatccattttaatactaattttacaggtgggaaattgtggcacagagaagttaaggctttataaaaagccatgtagcttgtaagtggcagagtcaggactcaaactcaggcagtctgtagtcacacttgggaacaatgaactagaagacatctagggtcctttccagcatcacgaccctctgattttgcttttctctggagcacactcttctcagttcctaagagagtattttatttctacttagcttaataaggtcctttcaaatagagtctatattaggctgtatttgatttttagccttttcactgtcttttatctcctcacaattacataaaattgttcacttagccagttatgaacaatgcagaagtcaaatttcattgcagtcccagaaatcactttatctaaaagtactataaaaaacattcattcttgactatgaagaggctgtacaaagttacctcttttcaagagagtcagtctgcccttgaaacttagtaatttactaaccatcatttttttttctaaaaagaaatatcaggcacagaaatttagagttgaaaggagcttagctgttatgtggtcctaacaccaaacattgaaatatccctgcctagactccctgaatgttggtcattcaccttttggagaagaatcttcagaaagtgaaattactatgtccattattaggtgttccattcattggtaaatacacctcattccctttctgaaatcagatatgccgtatatgtacagtatgtaccacataatgatatttcagtcaatgatggactgtatacacgatggtggtcccataagactataatgaagcatatagggtcttcaaaaaattcatagaaaatgcatattatgaaaaagtatgcatgaatttccaattttttacacaaaataaactcatactgaacaggatctagttgagtctctaagaaagatgagacatcagtttgaaaagagcccctatcacagcaacatgaatcctgctaaaattgaggcaagaacaaacattgaatttacactgaagcttgggtgtgagaatggtgaaatcattgatgctttatgaagagtttatggggctaatgccccaaagaaattggcagtttacaaatggatagctcattttaaaaaggagtgagaagatattgaagatggcacctgcagtggcagaccacccacatcagtttgcaaggaagaaaattcattttttccatgctctaactgaagagggtcaacgattaacagcagaaacaacagcgaatgccatagacatctaaatttgttcaggttacacaattctgactgaaaaattaaagctgaacaaactatacacttgatggttgctaaaattgttatgcccagatcagctgcagacaaacggaaattttcaataagtcggatcaagattctgaagcatttcttcaaagaattgtaataggagatggagcatggttttatcagtacgatcctaaagacaaagcataatcaatgcaatggctactaagaggtggcagtggtccagtcaaagcaaaagtggaccagtgtattagtctgttttcatactactataaagaactgccaaagactgggtaatttataaaggaaagaggtttaactgactcacaattcagcatggctcggaggcctcaggaaatttaaaatcacagcagaaggtgaagagaaagcaaagcaccttcttcacaaggcagcatgaaggagaagtgctgagtgaagtgtgaaaagagtccattattaaaccatcaaatctcatgagaactcattcactatcacgagaacagcatgagggaaattgctcccacgattcaattacctccacctggtctcttccaagacacatggggattatggggattataattcaagatgagactggggtggggacacaaaacctaaccatatcaaccagtcaagagcaaatgtcatggcaacaggtttttgggatactcaaggcattttccttgttgactttctggagggtcaaaaaatgacattatctgcttattatgagagtgttttgagaaaggtagccaaagcattagcagaaaaatgcccagaagcttcaccagagagtactcctccaccacaacaatgcttcagctcactcctctcaccaaacaagggcaattttgtgagagtttcaatcagaaatcattaggcatccgccttaccattctaatttcactccttcttctctctgtttttgaatcttaaaaattctttaaggacacctgtttttcttcagttaataatgtaaaagagactacattaacattgttaaattcccagtacaggacttgagggatgaactaaatgtctgatattgttacgtaaaaagtgccttgaacttaatggagcttatgttgagaaagtttatatatttcttacttttatattttaattttttttttacaaactttttgaagtccccttgtttaaagaaacctgatatatggcacttgatattagcattgcagttcaagtagggaaaatagttgatatgcagtaattgtgctgagagagttttccacataaggtggatgcctaatgacaattttccacatgaaaactatatttttatgtatatttgatgcagatgaaacatatataaaatataaagttcacaaatactatatgaacatcatagagtatatgtatacaaacctagattttatatataatatataatacataatttatatattatattataataaatattatatatatttatatacaattatatataatacaatatataatatattaatgttatattataatatatcaatatatattaatataactaatataattaatatattaatatacaataatatataatatataatatataattatattatatatttattataattatataatatattatctattatataatataatttataattataataattataatttattataattatataaataattataatttattataattataacatataaaatatgtaattatatattataattacatattatatataattatatattataattacatattatatataattacatattatatataattatatattataattacatattatatataattatatattatattgtctataaattatatattatatattatattataattatatatgtaaaatatatatattatatattatatataaaatctaggtttgtatacatatactctatgatgttcatacaatgttgaaattgcttgctgatgtatttctcaggacatatccccattattaagcaacgcatgactctgtgtgttagggaggtatatgtatcccccccatatatatatgccactcattggtcttaccttgttattttcaagcaaaataaaagtcggttttctttttccaaaagttgtatatatttatataatagataatattcattttagtaaaattaatatcttttcatggaagataatttagaaaagtattaaaatgaatacaaatcatccataatcccagggatcagcactgttgctaatatttttatattttcttctcttaatgtgaacatatatgcatgtactagtattctgaatatatctatttttaaactaacgggattatttatatgatcctattttctgtgtgtggtgaggctcctcctgatactctactacatacagatgaataaatttttaataatttttggggaaaatgaagaacatcataaaggtaagggcatctacttccagacaaaatgggataactgaccaaatgtgcactccttcctaaaataaaaagtgaaaatatataaaatgataatttgcaagacactgaaaagcaggaaatgaagggccaaaatctctgagaaacagcaaacaagttgagtcctatatttgccccagtttattgccttgagagagtctctaggctgtagtgcaggagaagggtaaccaggagatgaacttgacagtctgagaagacagaggtaaacagagttgtccagatagtatctaacggggtgagcaaaacgtcgaagatccatagaggaactccctcgaatattcagtgcatgcatgtgaggaaataacccaacactgggggaaaaaacacctaaaagaattagtggcaagactgcccagtgcccacacaggaccaggaacagtgcttgctcccattagtcagattagaattaggtggagtacacagaaggttcttgcctcaacagcaggaaataattggccttagatttagtattgctgtgttctggcctaacatagttaaaaagaccccaaaagatcaaaatgtttccaagtaagtcaatttcatcccaaaaaagccctcaaaaatatttatagaaatataaaaatatatccaacatcaagcaaggtaaaatttatcatgtctggtatttgatcaaaaattacaagcatgaaaacaagtaggaaatatgacccaattaagaaatataataatcaaatttgaaccagaattgacagatgttagaattggcatatgagaacattaaaatattgaaacttacatcaaaactgtgttccatattttaaaagataagtagagatctgaaagatatataaaaagactgaaaaaacttctggagataaaaattcagtctaagatgagaaacatactggctagaataacaagtaaattcagcaatgcaaaagaaaacatactaatgaaaacttgaaaacatggcaactgaaaatatcaaaaataaaactcagaaaaaatagaatccaaagaaaaatgaacagagcctcagtgaactatggagcaacttcaagtggcctaatatatgtgtaattggagtaactgaaaaaaggtttggggtatgaggacagaaaaaaatatttgaagagataatagctgacatttttccaaatttgatggaaactattcttatttttcatttaacattatgttgtcagaattcttctttctttctgtgtatcatgtgaaaacacagttcctgaagactacaaaattccctcccatggatgttttatgatttatttagccatttgtgcctgtacattttgattatgatttttcataattataaatgatgttgtaatgaatctttatacccataaatgttgatctgcatctgatccttgagatatattccttgaaatgagtttacagggtaaggttctacatatatttttagagtcttgatatataattttaagccattttccagaaagatcatatagtacttgtacatttgtacagtatatgtagtatgcattgtatattttaccacattctggtcaacaaatgtctttattaaagaataaaaagatattactgaaaaagacaaacttagctacttttgtaggtaaaaattataagccttaaaaatctgcatttcttatattattaatagctaaaatattgttcatgttcattgcaaatgccacttcatgtccttaggccatttttctattagttttaagtgtttttcttacatcaatttctaccagctgtttatatgttaaggatattaatattttatatttgtgatgaacgtttttcaaagattagacaaaatctacatgtttacatcatatgatgtattaataatttccagagctcccaccctctttaaagtgcattcacatttatcattgttcttatgtcctaaacttgcatctatttctcccttaaactgatattttctattttggttacagagcccaaacctaagaattaagtgtacactaatttcatgtatatcagaatctgttctgcttaattcttcagttcaccttatctaagtaatttctctttcacatcataagagaattaaaagtaattaagatccaatccaagggctatggactagggtaaagcctgtggtacaacttaatggaagaaatattttcttccttaggagttctatcagttatacttgagcccattgttcttgaaagagttaatgtcttatttctaaaatatgtctattatagattcaagtaaatccagctacacttacttaatgcacatatccagtacataagagaaatggaagattcctagcctgagtgccaggaaatgcagtttagatatggccctgccatctttccagaacttgatttccttcccagctacaaaatgagatccaaaccagatgatcctcaggaaccaatccagctctgaaattcgacaactttgtgattgttctataaaacaaatattacatttccctccaaaggatcttctgggattatttgcatctgttttagaaagattggaggtgggaaggggtcaatttttaatggctgcaggtgttttacaaatgtcaaagatacattgcttgcactgatagctaggtttaaaatcttcagaaaataaatgcataattagatgtttccagcatttatatagtgaatctgttcggtctttcatgcttcaaggagctaatagaacctaatgcttcctttgaaatcagtggaagctctaaacccatctaatgtgctagcttataactaacagaaaaattgggtcaatttttatcccactgatgaaaaataaatcaaacaagtgtatcttttaaacagcatgtaaaccatttaatacttagtgtactaggttatgtgcatagttttgggaaacatgaaagtgtgtgaccaaacagacttcaaatacatcatttttatacattcgagggtggttatttaaacaatgcattgatgaatccattggatattgctaggggtgggaaaaaagctttgtaatcacttgcatccaaataatacaagtttataattttatttttataaactttatgattataatcatattcatgtatatgaccgtgcatgtgttactgttaataacaacttgtgttttaagacataaaatggttttataatatgctcatggattcctggattgaacctgacacctctgggtttacttaacgtcctaaaaaaagaaacagtactctaatatggggctagatattactgaaaaagtcaactagtagcagtaaatgtcaaaattcaccttaaaatggcatctctaattataagtcgacagtagcaaagcattggcagtttccatgatattacatgctttacaacctcctgcagctgccagccaaatctccgtttctcttctacatttgcttttccttcatgacatttaatcagtcaacaatatgaacgctggagttctcctaagccaccctacagtttaaaatcctgactacttcatgttcttctgaaagtggggcggggagagcagcaagtctttcagaatgagatctgtacttatcgatcacagcatcagcagggaaattggcctttgtaggggtgaatgtggttcgttcactgagaaaggaaaaactattttgggttaaaatgaaggcaaaacaattcaggcagctgaagaggcttctgaaaactggaaagatggaatttccagggtttgggcaatgaggcagagactaaatttatggaaagcagacaggagaacaacttcaggttagtctaaaaaaggaatctggagagagcttatgtagagaaaaatcacacagactgaatcatacgtggggaatgaatagagggaaaacctgactctgggagctgcgattatagaggaaataaaggcagtaaagattaaatatcagtccctaacactgcctcaaaaaagcctgacaatatattcacagctgggtataacctctgcaggcaccactaagtagtccttccgttctattgagttccttccacagtttgttcctcccttaaacctctcatgagaaatcctttccctcgatatgctgtatagcgtgttaaagtgtagtctgaggaccagcagcattggcatctcctaggagcttattagaagtgcagaattatggctccactcaaatctactgaaactgaacacaatttttccaagatcgtagatgattcatgcgcacattaaagtttgagaagcactgatctacaacatatacgatgtgctgtctaagacttttttactgcatatcaaaacataggcagatagattacaactgtacatcatttattcattctcttaacaaatactcactaaacacaggccctattctcaaggagttggcactttgctaccagttattgaactcccttccgttctctgcattgtgtgaggtgtcagggctagaaggataaatatggcattgtccctgcccttaattagatcatagatatgttaggaaatagttaatgcaaaaaagtgtcatggttttaatgctaaaaacgtgtacctggcactgggattacaggagaacaagtattggagacatataaggaaggtggtgatcaaggtttttagaaatggaaaagtttttatagaggtgagctgagctttcaaaaaaaaaaaagctttttttcttttttccaggtggaccatggggcattgtgggcaggatgaaggaagggttagaaagaagggtgtacaagggagaggaaacaatcttaacaaaggctcaagggcaagaaacaggttggcctattcagagaactttaagtaattccatatggctggatgataggttttgaggagggtggattggggtctggtggtcagagataaggctggagagcttgacaggggccagatttagggggctgtattgtagcctaagcactttgggattgatcctacagagcagcaataagaagtcactgaaggttttccagtaaggcaataacaagatcacgtttgtgttttagaaacatcactctggaggatgtttggggaatggtgattagccaatttggctgaagcacaaagtacacagagaaaagtaaaggcagataaggctggaaatgtaaatttggatccagatcatagaggatactgactgccatgctttgtactttgtaggcagtggggagacactgaaattttctgagcaagagaatgctttagactgggaagagactaaagacagaaggccagttagaaagttattgcaataatttaggcaagaggtaataagaacctgatgactctgagaatagaaattaacagatagattcaagaagcaggtgcacaattataagcacagtttcattactcattttaggataccacaatttcatacataaatcagatctttataaatgtcttcattttcacatcctaatatagcatttacttctgtaccaatcactgggtgagatactcttaacgttctttgggtcaccaaggaaaaaatctccttcctgttgatttagtttgcaggtccctgtctcagttccatgtggaagccgctgcatgcctctaagtcacccaaacccaaaataaaaattttgttacagaattgttctctatttgcctctttggttgtttctcaaccctgaatatgttcctaggaaggcttcttggttattctttattcactttcaagaaaatagccttcccttttcccatctccagccccttttctagtcccacatttttttcacttagaagcactgattccactaggtggtaggtagggagatcaaagtcacatttccagttctcagtttttttttttttttttttttaacaatgtgagtaagttgtagggtaggtacatgttgatcgcatttcatatacctcaactgctgccagattggttttttgtatgatttatggttatggagctttatggctggtgtgaggttattttgaatttatttagaaagctctttcaagtgtttcagtttcacatcatagaatatttataattctgggtcaggcatcatgtttagcttgacttccaagatacagaattccaaacagccatttgctcctctaaatagatagatagatagatagatagacagacagacagacagacagacagacagatagatagatacatagatacatagatacatagatacatagaaagatagaagcacagtatatctgtttcctgtacatcaattttcctggtactggatggcttcattctttctaattcaagacccaccaggcctcgagaatgattagaaacattcatgctttaatattaatacttacaaaatctccctgttcttatctgagctttgcatttttgttaagatgcttagccagaatggaagctgcccacacaatgcttgtataaaaattatacttgctcaataatattcatatctccacccactcttgagtggaacagaacaagcattatgatatgcatgtacacatttgcataaaaatataccatacacaaattcaagtttgcatgcccagttccaaatgcacaccaccatagaaatgcacatttgaaaaagcatgcaatctcaatgtccagacgttttcctccctagagagtgatttttttcctaaaatgaaagaataataatagccttaatttatgtagtacatttttttccattctcctccctttacaagagatgagtcaattattttatgagcaacttaaaaaagcataaattttttcttcctttacgtatggagtaaggcaaggtgtcccaggagactagttcctcatgcaaattcaagggtgaagtgaaatttgtcaatatattcttccttttatgacagtctttccttctcttacagctacctcaattctttgccagccagctgagagatctctattgaagaaatctcttggctaatctcccagtttcccatctcttactacaaaaggtttcaattcacaaaacacaggctgacacaatcctattgagtcctcgcgatggtcttgcaattttgtaaactcatagagcagatgttatatttatttaacaaacatattttccacttctaagagttctttcttttttctatttacgtgttgtatttttatttcttcctagttttcttcttcagttttaattttttaagcttttaaaatttttttcatttttaattttcatgggtacatagtagatgtatatatttatggggtacataagatattttgatacaggcatataatgtgtaataatcacatcacagtaaatgaggtatccctaatctcaagcatttattatttctttgtattatgaacattccaattatattgttttagttacttttaagtatacaataaattactgttgactatagtcaccctgttttgctatcaaatactagatcctattcattctattttttttaacccattagccatccctgctcccacctggttcccagctacccttcccagcctctagtaaccaccattttattatctccatgagttcaattgttttaatttttagctcccataaataaatgagaacatgcaaggttaatctttctgtgcctggcttatttctattaacataatgtcctccagtcccatccatattgttgcaaatgacaggatcttattatttttatggctgaatagtactccattgtgtataagtgccacattttctgtggtacattttcatttccatttgtctgctgatggatgtttaggttgcttccaaactttcgctattgtgaatagtgctgcaataaacatgggagtgtgtagctatctcttcaatatactaatttcctttccttggggaatatacttagcaatgggatttctggatcatatgatagttctagttttaattttttgaagaacctccatactgttctccatagtggctccaccaacttacattcccacgaacagtgtacaagagttccgttttctccacatcctcgctagcattcactattattgcctgtcttttggataaaagccattttaattggggtgagatgatttctcattgtggttttgattagcatatctctgataaccaataacgttgagagcaccttttcttatacctctctgccatttatacgtcttctattgagagatgtctattcacatcttttgcccattttttaattggactactagatgtttttttcctgtagagttgtttgagttccttatatattctggttattaatcccttgtcagataagtagtttgcaaatattttctcctattctgtgggttgtctcttcactttgttatttcctttgctatgcagaagctcttcaattggatgtaatcccatttatccctttttacttggcttgctggtgcttgtggggtatttttcaacaaatctctgcccagttgaatgtcctggagtgttttttcaatattttcttgtagtagtttcatgtttgagacattagatgtatgtctttaatccactttgatttgatttttgtatacaatgaaaaataggggtctagtttcattcttctcgtatggatatctagttttgccaccatcatttattgaagaggctgtgttttcccaaatctacgttcttagcacctttgttgaaaataagttcactttagatgtacggatttatttctgggttctctattctgttccatgtgttggtttttatgccagggaaaatattcttcatacatgaaggagaacttggatatactattcaagggtaaaagattttttccttcagcactttaaatatgtcatgctactctgtcctggcctataagggtctccactgagaagtctgctgccaggcatattgaaactccattgaatgttatttgtttcttttctcttgctgctttcaggatcctttctttacatttggcctttgggagtttggttattaagtgtcttgaggtagacttatttgaattgaatctgcttggtattctatcacttttttgtaattgaatactgatctctttatctaggtttggaaagttctcttttattatacctttgaataaacttcctatttcaatctctcttcatcctcttgaagaccaataaccattagatttcccttttgaggctatttgctaaattttgtaggtgtgcttcattgttttttcttttgtttctctgattgtacattttcaaatagactgtcttcaagctcggttattctttcttctgcttgatcaattctgctgttgagagaatctaatgcattctttggtatgtcaactgaatttttctgctccagaatttttgcttgatttttaaaaattatttgtctttttgttaaatttatctgatagaattctgaataccttctctgtattatcttgaatttcaaagagtttcctcaaaacagctatttggaattctctgtctgaaaggttacatatctgtctctccaggatgctcactggtatcttatttagttcatttggtcaggtaacattttcctggatagtcttgatgcttgtggatacccatccgtgtccaggaatttaagttaggtatttattgtagttttctcagtctagacttgtttgtacccattcttcttgggagggatttccaagtattcaatggaaattgagtaatgtaatttaagactttggttactgcagccatatctgcattagggggcaccccaagcccaggaacactgagacttttagagacttacagaggtccagccttggtggacctgagagagaattgggtgagatctgagagaattccatggattatcaggcatagaattttgttgtcttcttttactttccactaacaaacatagtctttcactctgtgctgagctgcctggagatagggaagcactccctggagggcacaaacactcctgtggccacctccactgaaattgcactgggtcagatctgaagccagcacagcactggatcttgcccaaggcctgtggtgaccactgcctgactactgatgatgttcactcaaggcccaagtgttcttaagtcagaaggcggtgaatccagacaggcttgtgtacttcccttcagggaggtaagctcccacttgtcccaggatgggtccagaaatgctgtccgggaaccacagcctggagtcagaatccttaggaatccgcttggtactattctactgcagctgaactggcatgcaagccacaagacaaagtccttcccattcttttctctcctttcctcaagcagtagtctcccctgtgggtaccactgccccaggcccatgttgtgtactgtgtggctattgccgatattcactcagggcccaaaggctcttcagttagcttgtggtgaatgctgccaggcctgagtctctcctttcagggcagtgggctcccctctggcccagggaaggtccagaaatgtcatctaagagctacggcctggaatctgggactttaagagcctgctttgtgctctactccactgtgaccaagctggtgcccaagctgcacaacaaaatctcctttattcttccctctcctttcttaagcaggagtctctcctcgtggccagctctgctcagaatatgctgggccatgccagaagccagcatgtctctgagtctcacaaggcacgtggcaagtactgcctggttaccactgatgtttattcaaggcccatgggctctttagccagcaggtgatgaatcttgcctggatgatgtccttcccttcaagatagtgggttcccttctggtgcagggtatatctagaaagacagggaagatagtgcctggactgggagcctcaggagttaggcaaactgcctaagaccttatttgactgtggctgagctgttatttccgagttgaaagatgaagtcccctttactctcccatctcgtctcctaaagtgaaaggaaggagtctctctcagaactgtgggcttcactgccttgggctgggtgaggagtggtgcaagcagttccttggctggtgtcccactaggtcatgtacaccccaagtccaatggcttggaaccaagcaaagggctaagatttgcccaggaattacagtccttgtggcatagaccatctttcaagtttatttaggacccaagggcactttagcccacagtggtggggctagccagaacttgggttccacaagctggaacggataattcccctctgactagggatgctctaagtgctccctcataggctcttgctgacttctcccctgtgttgctttccactatgatggggcagcacttagttgcaatgcaaagtccagcaatcactgcattcttcctctcccaaacacacaaattctctctccatgccacactgcattgtcagggaatggggcagggttggtgtaggcaattcacagctgtctttcctaccttctctttcctagatatgatgttaaaaccaggtactgtgattgctcacctaaattttggttgttataaaggtggtttcttgtgtggacagttgttcaatatggtgttcctgaggtgggggagtacaatcgctggagggttctattcatccaccttgttccacttctctccctatttcttcaagcttttagaaagtatctgttaggatgtattaatttcataaattagcttttgaaagttgattttgttagatgcattactcagttttagatttccttatgtatttttgaattctggttttcaggcgcccatcctccctacttctgccttgcccctgaccttggcttttgacagtaatcctagatccagtctccactttcgcacaaaacttttagtcctctaccaaacagaaactgagactctgcgtcagaccatagtagttcctaggtctcaatcctgtatacttcttaggtttctattccatttgagggtcactgaaatgttctatcttgcttttgaacttggccctgtcttttagattttttagtcttaatttctttcccattgttatgtattataaacttatggggtcatattgacaggaagtttgtggcatcctcattttatttatttatttttaattttatttttgtatttcctcagagacctttgttctgaacctcattttacagatagaaatgaactgaaaaaggttcattagcctgctccaagttgcaaacctaatcaatggtacagtctgggctaccatttaagtctttcacttggctctgatgatcaaaatttatttcattttacagagagctgctctcagtgaactgctgatcagctgtgataaagcaaaaaaagtaaataacttagagtcagagaacctgaactcaagttctcactctgccaattactagtttctcttggcctcagtttgcaatattgtataacagcaatacagtcatgtatcacctaacaacagagatatgttctgagaaatgcatcattaggcaattccatcactatgcaaaacaaacatcaaagagtgtacttacacaaacctagatggtatatattttttatttatatatatgtatatatattttcttatggaaaaccaaatgccccagtaccattagtaatatcaatcatttcccctacttgatctgcaatgccaatatccagtaccagatatcaggtttctagatatgctctattttaacattatgacccaaacattgctatgtgacaaatgactatattaccaattaccttacacagtggtcataaaattaatacatgtgagaacttttaaaaaaaatgcaaagcactatgtaaatgtgaaagtttaaacagctaaaagatttgtcttttcaaagatatataaataatatgtgtttacttctgagaaataataaaatacagataagcataaaggaaagaaattgtttgcaatgtaatttagcagtgtattcttctagatttatctcaatatatatatttaaattagcaacttaatcgagcgcacttgtcaaaattttatctatatccatctatacagtaataaatcatgaaactgtctcctcaagaagttttggggaagggttttgacacaaaatcaggtaaagtaacattaggttatttgccaaatatagcattaattgtcttaccttgatttgtcacagtctttgtgttcaggtctcaaggacaaagcttccatttagatgaagcctttcaacaaactatttgtggattactcttctatacttcatggttgcaagctagagaatcctctttagctatttggagcagaagtgaatcattctaggtattaattagctcatggaatcttttggagtgctagagaatcaagctcagatgtttcacaaccagaaacaaggcatccagcgttaaagccaacagatgaaatatccacgcacactacccgactattctagaagaactgcacattgatttcacacatgagtaccagtacctacacctagatttaagagatttcactaaaactgtccctaaagaaccagacatctctatcaccatgcttgccacatgtggctactgccttctctgttcccttctgcatctaaatttgctcagtagaaccaaattcccaatagaaatgtagcttcaaggaaatctagaaataaagttctgttttgttctgttttaatttttcagctctatggtaggaaggtgagatataatggatacagaatgggtaatcagtaagccagtctgcagtatctggtaagtactgtaagtaggtagaggtaggcactgtaatttcccccattttacagataaggaaattgagccttagaaagattatgttatttggtcaataataaaggtatatagaaggaagcaaggatttcaacccaggtattctgatcaacattcaccttttaactactacaatatttaataattacttcattacatgacttctccttagaagaatatgagtgactgaagaacaataattctttctaattcagtaagtatttttcagtatcaaattctgggggctgcattcattcaaaacttcatttagtcattcaagacttttaattaaatacctactatgtgccagtactcttctagagacctaggaatatggtggtgaataaaacgcgcatagttcctgatatcatggaggtcagcatttagtgttagagttatcaggtgaaaaagtatgcattaattaaacgcgactaaaaagatatatgaaaataagagagcatttaaatgggagatttaagctagcaggtgcaggcaaagaaagatttcctagggaagctgtttgagttatagagacctgtaagatgagtaagtatcagctagcctaagggacaggttctgggaagacagtattgtaggcacatggaataaatagagtatgagatgtcctggaggttgaaaggaggtcaggggattgaaagaagtcaagtgtggctaatcatagacagtaagtaaaaactgaccctgcgataagtctaaagaggtagaaacccaaccaatgttcattgaatgaataaaggtgtgcaatctctagtagatggtagctgtgatgccttctaaacttcctgcttccactgagattccatgattccaaaagaggcagtatatctttgtatatttagaaaagaaaaggcgaggccagagtggtaaactctcctaaaattatcaaaacatattgatagtctacattaacactttagaatgaatcacttttgtggatgctatggattctgcaaggagaaaattagaatggacccatttgtctaacacctaaaagtaaaatgggaaagactaacagaataatttagaataattaaaattaagtagattagttttttctcttcttctttatttgacctttgagataatgttttgtctttatgaataaagaaaaatctttagaaatttgcctaaagctccttctcaaaacaataagtgtacagaatgcttacatcaagaatactataatttatttttaatatatttttaatcaaatagaaaaaatcaaactgccctatttctgtcaaaagaaaaatgtgaatatattccatctatattcagtaggcagaatcctcaaaataactaataccaaatacaagttttcaaatctttcaaagatttacattatgtattccaaagtaacagctaaaatcatatattaacttacacatatatcttttaagtctaccaataaaatgtgtgaccattgaaacacatttagtgatgagcaggagccacattcaatgaagaaaattaagtagcagtccagcctctctagactacatgagaatagatccaatatcccatgattcacaattgtttttaaatacatggtttatttctctattatttgaagtttgtttttttacacatatatctgaacttcaaacactgtctgacattcctgaaatagctttaatattacttttctttatctcattgccttctctcccaggtcaatggacaaagcttaaggcttccagcataaggctaatccctttatctgtcctctgaatctcattgtcagctgctttttcagggaccttacttaattattgctctcctctcagcatctacaaccttttcctctcaactaaatctttactctcaccatataaccatgctaaaatctctgtgctggcaaaaacaatcaaagacaaataataaaataacccctcaagtattctctcctcatctgcaattcttgtcttctcttttatttacatccaatatttttgaagagtcattggtacctaccagcaattctttctcacctctcactcacctccactgcaaactggcttttacccttatgctccaatgaaattactcctgaaactgtcacagtgaccttttagttgctacatgcagcgggcacttttcaagttgggttgatccctcaggagcatttgatactattaaccagaaatttcctggagcatatagaactgtaaggaacaataagccatgttcccagaatcaccacatggaagggcacccaattaacactcaaataaactattctttgtgcactaaataaacctgcattgtgttagaccaatgggatttataaaactgttccagcacatagcattacttaccttgacaaacacatgagtcttattaggtcattcttaatctgtctccctgattacccaccattcccctgctgtgaactctatgccctagctacacaaaccactgtgtgtgtatatgcatgtgtgtgtgtttgtccatgctattctattcttaattcctttcttcctattatttgttgacacattcttttagtctcacttacagcctttgagaaagcttccctgtttctgacaagcatatttactccatttcacctcatatatctctctttgtagcactcatgctattgtatcataattgttttctgtctcttaagaatggattcttaggtttttggaatatgtaaattacaggaattctaggcatgctttatcaaaacaaggttgaaatgataaacactgggcccttacataaaattttgtaagaacatcaggttctgacaaagaagaacgaatttgtggttttatattttgtttccctttagttaaaccctagatatcaaagatttataatttcttaaaaataaaatcttgcctacttttgggcaacaaatacatgaaccaaatatcctttgtatctaatttccttagaggtgattttctatgcataacagaattatcttttgcaaattatatttgcatatgatcagtcacattttttgtatttcaaatgtattaatatttcaattagctaaaagcaataagaaaaagatttatctagtctgctgtggaagtgctaatataattttaaaaaacaactaagagcactaattttgttgtcaatttcatatccttataattacctcttaaataggctgcacttctctcatggtaatcactgctgttttcaaatggcttgcaaagaagaaaagcatttaagctaactcctagaacagatgaaactatttattttgacatttgtcggctttggaccatgtcctttccaattctgaaaaagacaacctgggaacttacgtgtttagaacaaataattttaataactttggaggtgatttaaaatggagccaattttaggtgtcagataaaatgatcctaattcatcttatatcaaagatactgggcagtgacattggttggggtgtggtcaaattgttactatgccaatcactcagtaaaggagtctgaatcgtcagtggacaagatctagagatctgagaaataactcctttctttgcagccctctctatgatagacactcaagaatgagagaaaatgtagggtcattcttttaggcatggtcatatcaattcaaaggaagacaaaatagtttaggaagtggattctaatgcaagagatagtttagaggaagaatggaaagtgacgttagtatagtttatgaggtagtggtttcagttgttaaatacagataaagagaacagaagaatataaatattctaaactgtatcagaaagaatcatggaactttaaaagcataaaggactttagagagacatcattttcgttcagtcctttcattttaaagaggaggaaactgacctttaaaaaggttaaatcacttgacccaggttgcacagagagttagtgaaaatagtgtctgtgggttcctatggtggggatagggaagaacatgtaagggaagaaaggaagtgggtctcttttcattctgatccagaaacgcaaatcctttaaaaggtaggcagacctttttaaaaaaacagctggcatcacctgcggagctgagccaaatgctgtggttggtacccagcctgagcctaaaaaaaatgctctttgtaaaatttctctttgtgcacggataaccttcacaaaattagttcatgcttgcttttaaattactttgcacctgtcctaatcatacctgaaggtggcaatgtcctaagagttacatagggtttgtaaaattgggctactggcattatttttaggagcactctgccttacttaatttggagaacattttttttcctactaatttcgatgccacatgctttataactcaactttaattttcctccaaagatatccaatttattatccttgtctttagtgtatatttgcttcaagagacagtctccacaatgctgattgggatatcatatgaattccataaattcattttgaagtccttggttttagcttataggatttctacattttgactcacttttcttatgtattttcttgatagttacccccctgcctaaacaatttaactcttccttttctttttttaacttagccacctccctaaatgcatgtatacattctctctctctttctctctcacacacgcacacacacacacacactctctctctctctcctccccttccccaccaccacacacataaaatcataaaagctgttttcccaaatggagaggtatgaagcatgtgagaggtctggagaagaccaggagtcataaatgtgcacaagccaacttaaaatatgttatgaaggcatcagcgagaatgtcagagtaggagactccaatagccttactctccactgaaaagcaaaaaacaaaacgaaacaaacaaacaaacaattctggcaaaactgtcagaaacaaagttactgaaattctggaaaatgggatgtctgtgaaattctgggatgttattagatcatggggcagatttcccctttggtattgttttcgtgagttatcaaagatctggttgtttaaaatgtgtagcacctcccccttctctctcttcctcctgctctggccctgtaagacgtgcctgcttccccttcacctactgccagtcaaaggtttgcagcaaccaagagaattcttaatcaagagaaagggccactgtaacccagtggaagaggtttatagtattttaatttatttgtgtccatccccaccattgctggcttaatggtggtcctgaagaaagcaccttgttctaccagtgtgggtcctggtaccagagggagcagaacagattttgttctgaaaaaactgtggttgcctgttttgacctatcaggtggtttcctgaaggactaacacaggggacttgcctttattttgcctaactcagaactctcccagggcacaaacatggctgcacagacagcatctatataaatacttaatagcaaatcaaccagccactgctacgcccatgagacaaagaatattagatgggataaacaataaacaaaacaaaaaacttgagaagaaggctgggaagtgagatgcttgggggagtaagggctttgagaagcttccacatattcccaggtatctagaaggtcacacacatgcgcagaacaggccacatgatcaaatgatcttgagaagatcctaaagtctcacctttgggtgaacttcagactctgtgaaagcaggaaatgaagttgaaggcagagttgtaaactgcttagctgagtgttaaaggcctgccccaacatacacacagagcccagttgcaaagactgagagagtttttgttttatccaggcatttaaggaaatctttgtcaaatcactagctgaccattgagttagtagaacagagatttcagtgaccacagaggataaaaaatactgtcagtaaaaaattagaaaagtcactaaacatacaagtacaacccaagacaagtagcaataacaaaaacttggggacaagaagaatcggatttccagttactataatatttaaaatgctcagttttaaacaaaaagatattagacttccaaaaaaaataataaagtgtggcccatttacagggaaaaaaagaaatgaatgtgaactgtccctgaggaatcctagacactagatttactagacaaagagattaaatcaactgtcttaaatatgtttaaagccatagacaaagaaccaaaggaatatatgaaaccaatgtctcaccaaataaagaaggcagaaatgatataaaggaaacaaattctggagctgaaatgtacaagtataatactgaaataaaaaaatctctagaaggtttctacagcacttttgagcaggtagaaaaaaagaatagaaaacatatagataaatcaattgaaattatccattctaaagaacagaaacaaaataaatgaagataaatgaacagaacctcagcaacctttgggatatcattaagcatatctacctatctagctatcggaatcccagaaagagaggagacagaataatggacaaaagaccaaataatggctcacagtatttctacattttggctcacttttcttatatattcttcttgatagttaccccctacctgaacaaatcgagtcttccttaaaaaaagacaaaaaaataaaaaaactagctacttccccaaatgcaaatttaataaaagaaataaatctacttattcaagaagcccaacaaataccaagtaagataaactccaacagatctaaactgacatattataatcaaaccatcaaaaaccaaagcaagaatcttgaaagaagcaagagagaagtaactcatcaggtacaagtgatcatcaataagaataatatcttatttaaactatagaagacttaagacagtgaaatgacttatttaaattgctgaaagagaagaactgtaaattaagacctatattaagcaaagctatcctttaaagatgaaggagaaatttagacattcacaaataaacaaaaggtgaaggagtttttcactaacagactggtactgtaagaaatgttaaagggagttcttcatattgaaacaaaaacacactagacaacaacttgcagctacatgaagaaataaaaatcaccagtaaaggtaactacataggtgaatataacaaacagtattattgtaatttcagtttgtaactcctcttctttttcctatgtcatttagaagacaaatgcataaatcaataattataaatttatgctaatggggacacaatgtgaaaacatggaatttgtgacaataacaacacaaacacatgggagagacctatattaaagcagagttttatatactattgaagctaagtgggtattaattcaaactcgattacttataaatgtaagatactaactgtaattccaaaagtaacctgaaagaacaagtgagaaatgttcagaaaagtaaatgagaagggaaccaaaagggattacaaaaggaaattaaattaataacaaaaatgtaactaatatgaaagacaataatggaggaattaaggaacaaaaaggttataagacatcagaaaacaaatagcaaaatggcataagtaagttctttgttagtagctactttaagtgtaaatgaattatactatccaattaaaaggcagagattagaaaatgatccaaatatatactgtctacatgagactcattttagatccaaagacacaaataggttgaaagttaaaggatagaaaaagatatttcatgcaaagagtaaaaaaagaaaaagctggagtggccacactaatatcatacaaaatgtactaagtcaaaagttgttataaaagaaaaagggaggcattatatattaataaaagggtcaatccctcaggaagatgtgacaattaaaagcatacatgcacctaacaactgagtcccaaaatatataaagcaaatttgacagaaatgaaggcagaataaacagctctacagtaatcataggagatttcaataccctattttcaataatggataaaataactatacagaaggtcaataagaaaataaatgacttcaatgatactgtaagccaactagacctaatagagaaatacagaacattctctggagctagatatggatgatggatatacaacactgtgaatatactaaatgccaatgaattgtataatttaaaatgtttaaaatggcacattttatgttatgtatattttatcacaataaaaaacgtttacctattgatatggtttggatctgtgtccccacggaaatctctgtcaaactgtaatcctcaatgttggaggtggggcctggtgggatgtcatttgatcatggcgcagatctcccctttggtgctgttctcatgatagtaagtgagttatcccaagatctggttgtttcaaatgtgtagcacctcccccttctttctcttcctcctgctctggccctgtaagatgtgcctgcgtccccttcacctactgccatgattgtaactttcctgaggcctctccagctatgcttcctgtacagcctgtggaaccatgagacaattaaacctcttttctttgtaaattatacaggctcaggtattttttttatagccgtgcaagagtggagtaatacagctatggacactcacaaggaaacaatgcattattagaagggattaaaaactatgatgaaaaaagagcaccaaattatttaacttaataaatccatcacttctacaaacacaagacaactgtagacatcccagttctgaggcaggagggtataagataaaagaagctgctaaaaattagtagtccatatgaaaataaaaacaaaagctaaaaagtggaaaaccatgaaaaagttttctgtgtgagaaagaaatgagattggggtacaaaggtactgctttttaaatgaagaattctaaaatgatttaaagctttaaactgtgtgaatgcctaacttgttttaacatcaactgatgtttaatattaatgcaaacatcaattaattaaacactccaacccctcaaatgtagtgtaggaaaaaccatactcacttcttaggctcagtattttcaaaatgattggatcacatccacgtctttctgaatgcattcagctacggtcacttagttctgcattggttttgtgtctgtcttaatagcaatcactccaaacctaatagtctcagtcacagctctcaagtatttttctcttttcccaaatcattctcattttattttgagaactatctcccttatagtaatctaggtttatgagtcattttcaaaatcacaaagtgctttatcattccactttttgaaaatctctagaatgtaagtattttggaaaaaatcttggtattttccaccttgtgagtctgctgatgggcagccagtaaagtcagtgctgttgaattaaaataggcaacacaacaagacaagggacattggtcatgcaagtcttatttcctgaggcacaagactttgaaatgagtcgtacaggttttacgatgatcaactctcagaggccaaggcccactaaactaactatatactaaaaaatgagccattgtaaaggaatattttcttgtaattttaaattaaactttttgggggtggtcttttataatttttaattttggtggtaatcctggagtttatttgcactatttttagtttttaactttttttttttatttttgagagttatgggaatgttagtgtttcaacctgtgatggtagaaaacacattttaaaataagacagacctgggtttgaattacaaagaacttctaagtcatgtaagcatagataaattagtgtcttttcttaccttcggttttcttctctataaaatgataatgtccagttttccttgttgtcatgaggattagaaataatacagataaaagagcaatcacggtatatgacaaagaacaggtgctcaaattggtggctttatatttatagttaaagcatagaagtattaaagtcctcatgcctcaattagaccagttcttacattttaccagaaaggaagctgagaatcaagaagagtgatctgacatacatcaataagataaagctagataattccagagattagtactgaggtttcctgcttaagcaacaatctcttccttcccttgggctctcttcactatggatgaagtctactatttaaaggaaagtttaaaataatttattgaacataggagaaagcatacctcagaatattcggaaatgtgacttagatgcaccttctgagattgaaacttgaccaaagatgacccacattttctgaagactttgccaatgtctgcttgttagtgacttggaaaaagtagatactgaatatgaaaagtacaatttcttcttgcccttcattaaaacaaaataaaaacatgttctttactccaagactaagtctgacctgctattatatttgataaattaaagttcttctaagattaaaaaaaatccctttagcaaattgttccagctaacatagtacccagcatacaataaacatttaataaatacttgttggatgaacaagtgaatgtgtacgttctcataatgctaatgagaagtaatgattaaaacaaaagtataaataagaatgacagaaacatcaagcattctgatgaggatctgggaggggggagtctgctatgagaacagcttgctcagacagagaaacaccaaacgacttcaaaaaaaaccacactgacttgagttctggcataactacctcactgcaggcaacaaaaattctgctttgcctttaatcaatgtaatgaaactgtgccttaacatgcttccttatttgcatatctcttgtaatccgtgttgcatacaatacaaaaagatttattataaagaaattaatatatcttgagaggccatccccatcaggcaaaagacccatctgaagataaaaatcacaccatttataaaaaccttagaaagatcttacaaatccatgaattatttacttaaaaacttaaacatccagagattgagttctcagctctcattggcaaatttgctcctctaaacatttcctaatgcacatgaaaactatttccctgagaatccagttctctaagtagtcgagttatagagtctattatagatataactaaagattctcaataacttttaaaaactaaattatgacatagtctgatgaagggtacatttcaccttataaactgcttcatattgtaattcaaattgtaattagactcttcacccctaaacagggatgttatccccacaagtttcactgtacacaaaactgaatcacattagcccaagccccggttacccttctcctaattagaatctttgcttctccccagtatgaatctcacaaggataccagaccaatctcattagaggcaccacagtatgatgtggtctttagaataagatatacatgggtgaaatgtggcttcactccattttatctgtgagctcttggatgaatctcttatctcccttatgtctcagtttccttacctgtaaaactgagataataccaatcttataaatttatgaaggagagtaaatgtgtgtgttgtctgtaaaaatcctggcatatgataagcacataataaatggcactggctattactatcatcatcttgtaacatactggtttctcatgtcacttcatacacaaaaaccacaataagatacccaggtcatatcaaattaaattcaatctcttctattgtgtttttaatgctttctatattctgaccagtttcatcttctctcccagaattccagagcataaattataactctggtcaatttagtttccttttaatctttttcacttagcatgtcaattcctgcatgtcaataatgttgctattattttctttcactttgcttgctccattatgccaggaccttcacattccttaagattttagatcatgtcccatccatttcctctatgaaacagactcttaatgacactagctcactgctttcttctctagcttctagggccaggtcccttagaggaactgggaaaggatggaatttctgtgtgatgtactcacatttttctctatgagagcctgctcttctttctatgtaatcctatcactttgagcatttattttacactgttatggaggccactagtgaatactaaagtaattttcttttccattgatgttactaggattatagtccaaagaaaggatgcatctatgtttatgcaaattaacttgatttcagctaagcttcttattggcacactgggttctctcctgcttcatgcaagataaaagaagtatcacaaaaatcttatgaactaactggtaaatataagttaaataatagcacagtgtatatactaacctcaaagaatattaataaatgggtctatacaaccaggaaagagatctttagttatatatcactggggtctgaaatgaaccaatgaccctttttctgttcattagagacaacatggggtagtgtggcaagtctcatatactaattcctgggttctactccacatactctgtagagtaaagcctagaaaacatatgaaaatgttccttgtatggttttggatgcaccagaaatcataaatatagtggtcaaactacatgcttcaaaaccaaagatctgaattcagagtttgtctctgtctttttgtttgtacgtgatgttgtacttacctgaacctcactatttcctcatgttgagtgttaagtgacatgatgtatgtatagtgtctcacatataacagacactcactaaataggaatcatttatctattatttggatgaatacccaaaagaaatgctcattgaacccactgttgtcacaccattaagaaagagaatgaatacaataaatgctaaaatgactttgagtctcgtactactaggccaaacacccataatattaacatggataagattactaagtggatttaggttgcaaaatcaattgcataagtaaaggataggagacctgcagaataataacagttgacaggggagaaaaaaaccacccagaagtttttattgactttaagttcagtaagagataagtatatgactcaaacaatctttgggataggaaatagaaagttgggagggtattagcatatccaacggtgtttgtaccttccacagctcttagtacagtagcttctttacagaaaaaacacaaaggcattataatgatgtgtgatgtcaataaaaggtcaatatgatcactgtattactattaataactaacagtatgatatctaatacttattgagtgcttattttaggcaatataatatgccaaatgttttgcatgtgttatttcctttaattgataaaacatttatctcaaaatctttgtaaataaccatttctttgaatccccaattttaaacccagacagtctgtgacctaagagagcggaattgctaaatcatgatactaactcccatttaataaggtgactgtgcttcaggtttcataattggtaagtggagattgggatagtgctagaattatttccttggctttgatgctaatttctctgtgcaattcactttaacaattacttcagatctgcaatttgaagtatttgcagtcttattcattgttttcctgccacaaatttattccttaaccaaagtttaggttcattctgttattttaatgcctttttagttgtcttttgactaaaaggtgagtaatactaatttgggagaatcatattattcagaattagataagcctcactgccctgcaaaaagaagctcacttctgtttgcttggctttctgatttggtggcctctgcatggagattcagatttcatttctcatttacatttgtcgttttgtcttctaatagtttgcccccttataataccatgtttgctaataactctgctttcatgctgtttgccaatgcagaagggaatatttttctttaatacattacatttcttccctccctacttaagaactatttacccagcttacaccatgtacctgtccatttatttggaatggtatatgttttgggatccttttatctcctttccatatttgaataattatagttattgatctctgtggcaaacctacccttcgtagtgttttatttatatcttttaccttttctcagtgaagagaaaaggatggaaattataataaaattattaaaatttataaaatccagggtctaatcagaggacagaaactacaataattgaacaggaaaagtttaatgtataaagaattagcaactacaacaggggattagaatattgagggattggtcagtaaggagtaaagggtactcttaaaatatacaggaataacagatataaggaacagccactactctagaactgatatagatgcccaacgaagacgcttgcctaccctgaaggctgagatctggaccttgtcagggagggcacagccatggcttgtggaatggcaggcactgaatagaatgctgtgccagcgtaagttgctgaagatctgcccttcagaactttatggaaatctgctctctagaatgccagggaaaactgtttataggcatgtgtctctctggagtctctcctctatgaaattgtccaaagtgggtgctgctgaccaccacgcactggcattgtgcgagcctgatggtgcagttgctgtttacactgaggagcctgctgagagagcatgccagcatcaggaaggaaaattccttcctcctgtgcttcaattgaccaagctgaacgttgtacacgctggcaaaggaaaatatttaaagggctcatctccatttttgcagaacaggcaatggagtataaatttgcagatgagatacaataacttgataactggtacaccaggtaacctgtatttaacaggaatcctggagggccatctggttcaatttcctatcttccagcagattgatgcctaagctatctaagacagatggttgttaatgctattaatatttaaacatgagttccctttaaaacctgctttactctttaaaaaccgaagccagttaagtctatacgtgtttactagagagaattttggaaatactaaaaaattataacagaaaactaaaataagctataattccagaatttagagaaaactaatgctagtattttggtccatattcttctagacttttttttttttggctactcatgtattcatttaaaacttatttagcatctattaggtctaggcacaatagtaattgttaggtgtacagtgacaaacctatcaaatgcctcctcgtcaactgagaatctagtgaaggaatcaaatacatctatttatgtatatataaatatgtataatacatgtatctatttataacactttttaataataaaattgggttcattttacatatgctgatttggattcagctttattcatttaacattatattaaaaatattttccatgttactataagtttttggaaagtgtcatttttttcatgactaaataattaaattttatcatttaaatatggtttgatttcccttttttctattgttaggcaactttttagcattttaaataatacactttgcattatacccatccctgcatgatagttaaccctgtggatataaccatgctcctgagtttaaatctcatctccagcatgggctgagtgatttagagaaaaaacacttaacttctctgacttcagtaagatcatagtacctgcctcatctgggtgttgggtggataaaataagtttaatatacagaaagcacctagaacgctgcctgagaacataagctatttaagtattagtattatactcatcatctgtttatgtgtctgtgtctccctgagatgtaattgccttggtggttttgcctactattatgtccctaacacataacacagtgtcttgtccatggtacaaaatttaatacttatttaataaattaggtgaaaaaaccctcatatataaatcacattactagttgaaagagtataaacatttttgaggatcttgatacttgctaaattacatttcagaaaagtatcaactcatattgtaactacaatacatgataagaatgcccttcttagcctgctcttagacattagatattacaactttttaatgttttctatttttttcataacatattgcattatactgctgctttaatttgtatttattcaattgctaatgaggtggaacatgtttttccaattgaatactattcttcaaattgtctattttctttcccaattttctactaacataaggatgtttttcttactaatttttaggaattccttttattgttaagatagttaccatttttttaatttttatataggttaacatttacttcttaattttcatacactgctttgtggcattcagctgatcttaatttttatgtagtaaaacatattgattattttctttataattagttgcatgattttattactagacattctcccccatgtagaagtcagtaaacacaagacccatacttcattcaatgttatttgaagttaactatttaatccattgaaatttattttaccccctctaaatagtgactattctcaatatcatttgtataattcattcttcccataacatgttgatgcttcccctataaaatatcatggtttttatatttagtagggtttttatattctattaagtttcataaatttctacattctactggtatctacaattttccaagtggtaagtttaattcattacattttcatatttagtagggtctttaaactctactactttccatggatatctagaccctactagtaccacagtttttaactggtaagtttaacacattctagtatcttgccgggaaaagttcctgcctgcccctcactgtgcatgtgtgtgcatgcatacacacacacacacacacacaggcacagaattctactccatcacacatcatccaaacaacaaatattatagaatgccctatatgtagtcaggaattgtgtcagatgacatgaatagaacaacaggtaaaactgacatagtcccatcccttatggagctaaaagaatgtggaggtagaactaaacaaacaagcagggaattctactacagataggctatcctagggcaagtagagtatgctatgagcagccactggtacagccatgggggagaaagaaaagcttgccacagaagatgaaatgaaactaaaatctaaagtgtgtgagatataaagagaaattggccaggcagaaacatcaagacaataatgaaataaagaaattgatctctctaccccattgttcttttcaaaattcttttaaatatatttcatccatttattcattcaagttgctctaatgatccagtatctcatttggtttggaagctcgggatgaaatattgctctgttatccaactttatgcatttcctctataattcaggcacttgatacaaactagtctactacttttatatctggtatctacccttaatgtacatgttagctcccattttcctacctttctctcttgttatatttagtaggatattttattatttaagtagatagtttcatactcattattctccagggttcattgcttactacctatgtggcttgaataaaaccataaataattactttctaaaaagattgaaagaaatatttgtagttaagtgtgccaagagcataaaaaatacagcttataaaaataatacaattattctttctataggagtgctgaggcttatgaaaatagtttcttattgttaaaaaagatataaaaaatgttcctttaaatgaatgatttccatatataatcagcttaacaatatctttaaaaattgtgttcatttacataggtaccactcacctcgtgtaacggggaatgcaaaatatgatgtcattaacccattttgaccaaatatgcctaaagaaaactaatgcttcaagtatcgatcaacatttaacagtatttttaatctttatatatttatttcaggcaggatactagttaatttagtgtaaaccacgtttaattatttctgtttattttatatatcctgatagtaatataaataccaattacactttttacagtcttgtttctctattctttccatggttttggtaaagtgttaatagtatttcattacatgttttcacttgcagggcttgctgtagaatacagctcagtttaaacagtcaattaattttagcagaactgaaattgaatgatgaaatatttctaggctgagaagaaaactacagtaaactcttagcttttctactttgaattggaatttttgctctttttcacttctcagagaatacctaatcccgactaaataattaactgactggcagcaaaatgcattaattgtggagaacagtaagctgggtttgacatccatctttgtcactaacagaatctcatcatggcaagagtcacttaatgtcttcaggtcacactattttattatttgtgaaatgaattaataggattacagactcttcaaagtccttactacctctaaaatgttaaaattctgactctaccttgtacataaaaagaaccagtaattccagtgtgagtgcaggggtttctaaaggccaaatatcgaatactaaataatatactatacataattgcatgatttgttcacaactattcatcccctccctcatcacagcttctctgtggacaaagtatattccctgaccactgattttgggctggtccctgtgatttgctttgacttatgaaatattgtgaaagagacagtgtggtaatcccaagaaaggctttaagaagtgctacatgcttctcatcactttcttaagattatgtcctctttcataagcacagcatgtacaaaatagtggttttcttgagcctgggtctctcaatgaaaagatgtgtggaatagaacaactgacccacgccaagctgaacctagtctgagccacttgcaaacttgtgggcaagaaataaatctttgttgttgtaagccattaagattttgcggtttactggagatcattctgttaagtgaaacacgccaggcacataaaaacaaacacacattctcacttatttgtgggatctaaaaattaaaacaattgaactcatgcatataaagactagaaggatggttaccagaggctgggaagggtagctgggggactgcggggaggtggggatggttaatgggtacaaaaaataatagaaagtatgaagaagacctactatttgacagcacagcagggtgactatagggtgactacagtcaacaacaacttaattgtgcatttaaaaataactaaaagagtgtaattggattgtttgtacacaaagaataaatgcttgaagggatggatacctcattctttatgatgtaattatttcccattgcatgactgtatcaaagcatcacatgtacccccataaataatatatacctactatgtaaccacaaacattaaaaataaaaaaaattaaaatattttgtggtttgtcatcacagaaaaagttgacgaatcaagtactaggtgtactttttagaaaactgataaaaacaaactatttttgaaagtctcatttcaaacgctttattaagtaactccttattatcagggcttttgttccttccttgatgcctggtattgtactgtatcacctaaattaaacataggaaagaagagaaggaaaagtatgttgaatgggaagttaataatgtgtctctaaagctatttctcagaattagtaagtgttcagagtacaaacagatgagaagtttggagtcaaccttctagcagtgttgtcaatatatcatcaatatgatatggttaataaactagctttaatatgattcagtgaatcttgtctgtttctttaaatttgaatatctatatggcattttcaaattgattgaataaatgtattattaaaacctctaaaatcacataatcattgggataactcgtgatttgtttacactttgtaatagcacactgggggtgggggaaatgatgaacatttgaccacatttaatttcaaaggaaaaatttgaatatattttctgttcgcatttccttaacattcacataagtaattaagatgactaaatacttatatcagtacatgaaagcatctatggaaattccaaatgccaggaagaaagtgaagcaaaacatatatgccatgtaggaagataattatacattttaaaagtacattatcaatccaaaataattatgaagaaaatcctaataatcgacttcattgtagacaatatcctaacacatcataaggacattgcacagcttagtgaaatgagatagcatattgctaaaatctattggtgtcttaaaaagtggaggggattttatgacaactataaccttagcaattttatctatacctataaaataacttgatataataaaaccttatactcaccgccaacattagacgagttaaaatttcctgtcagtctgctgagagacttcattatacattatctttacatatattatctcatatccaatcttcataagaaagatcctacgagaggggttctgtcattgtccttactttatagataaggcaactgaggtttagaaacataaaatacattgcccaaactaagtggctaaaggtcagaaaatatgacttaagaatttaaattcttcatgttaaagtgtgcctaataaatggaagagatgaaaaagtccttcaggtcataagcttaatttgaagatattaaatgtctgtcatatccaaagttacatagatggaagcagaaattaaacaagaacttgaattttttattacggtatcttaacacattttactatatatttataaaaatatctgctataaagttcttgaaattttatttccaagcatgtattttacctgcaaagtttcagggtgatttttatagtcccatatcttaataaacgcagtcaagttatctgctaatttttacattttctcctctgaagacagctcaacaacctctaaaagatacattttatcccagtagggggtctaggagcatggaaataattaagttttaaaatgtctttgttattttattcatatttgatgacttaattaagggaattatgagataaatacccaaagcaagttgatcttaagagtaaataattattatttccactagggtcgaattgcacatctcagtgatgtttaaaaattattgtaacatggaggatggttatagatatcctattaaattgtcaaacatattgcaaagattaggcaaatttttttcattacctcattatggttaatgcagataaaagactccttcctctacttagcctataaaaaaatgcttagaaactaaatgtttagaagacttcacaaattccacttttagtaaaaaagacaagtgatagaataggaaggtaaaacttaaaggagaaactagaaactaggcagtaaaggaagggagaaattatagaagaaattatttcccttaataacaaatatttcaataaaatgtatttagtaaaatctttaacagacttgttcattattttaccattgacttaagtaaaaaagcagatgaaatgctatgattaacaaatgacatgatgccaaaggaaataaataatacagcgtataagtgatacaggctaccaagaaatttaataaggtgaaatttagaagtaataaagacaacattttgcattgagatgaaaaatagtcagcattccagcagaggcagatttaccacacaggtcatgaagcttaagcttcaggacccttgatttacaccaacacctttcagagcctgtacctaatgtatatatgataatcctattattaaaggggacctctaaaattatataagcttccgacctccaaaaacctgactatgcctttaagttttaattccaataggataatacaaactatttaactctgaatccaacaaacctttatgcaacaaacctttcagatcaaacaaggacaaataaaatcaccataacccataccagagcatatcttagagacagaagccaacttacatgtaaacgggagatatattcatttgagaccaccaaagttggctccagagcccttaccttagtgagatggaggggacttgtatatataagaggaaaactaggcatgtttccaaatagatacaattagcctccctctcaccaaggggagggctctgaagccagctttggaggtcttaaatgaatatctctcccacttacatgtaaattgacttctgtctccaagaatgcccccaaaaggagagagtccaatcagtaccacccttaaagtttgtaagatcctgggcaaatattttattttttgcaggactcctgtctatataaacagtttgattaaagatgtactgcaaattcatggactcatgcaaagtacagtgatttattaatgaagagttagaataatgagtagacaagcagtatatatatatttgtttattgtacatgtttattgtacaatcagtgcacatgaagattctttgtagtgtctgattactgcctatttctgttcagatccagaaaccataccttcatgttccctattgtcatatgtcccatgcctaactacttccgcatctcccatctgagaaaaatgtagcaatgctattattgttactgccatagctctttggaaactgtgtgtatttaagcaacacagaccattttgtacctgtagttctctaatatcatttacttaatgctgtacataattactcatgacactgcatcatctatcatgcaccctgtggattctgacttcggtgactctcttgaaggttgttatggcattgatggtcatgaacgcaagtcattcccagagtatttcagataatgtgaatgatggtttgttttctggtcatgtttttactgatggtagttttatatcataaacttatcttccaaccatgtgtttcctcaactatttagatcaaaaccactgcattactgattgcattgctgactgcttttgattattgctatactcccaccttccacaaactgccaccaatgaggaagatagacaagggtcctaggggcagtgagagaagagactttctatttctgtaaatgaatgtccattgttcattcagcatggcttagaattggtccccccaccccaaagaacacaatatcactgcatcaattgtagaatactgattgaaaggatccactggccatgctgagcaacaatctagaagagtcttaccggaaaacagaatgatcattcccagaggactgcttgacatgtggcatggagcctgcagagggattggggtaagcatcttgggtgccagtggctgggagtacattgggttgaggatacctcctgcagctcctgccgcccacaagggctgcccacatgggcagacacacaccagtgagcattaacacagaggcccaaagctcaagcccaaaggtcagtgacaaatagttggtagcccagagctctgaaactcatcctatgtcagacattgagtcacccaagtacatatatcagcacaatctgatagaccaatttcatgtgatcccacaaaagaaatactgtggtagccagcaggagggatccactagccaggctgctctcctgaaatcaaggctggccatgggtcctgggacaactcagaagggtgtgagccccagagttcttacaggtcaggtggatgattccgggtatagagagtggagagttgtagagtgcctcaaaggtaagaaataggaacccgggcccatatggatggatcagggcccttaaggcacagggcctgaggcaaaaactacacttccctgggcctaagggtggttctgggtccaattctaaatgagaaagtattcagaacaggtctgatccctggggatcagagtgctgaatgctggggagtcagaagcaacttagcgggcaagaccagaagtggcggtctctatcaggtacctcttctgatggagaagggggcactctaaatattaatagtacaagagttccttggaggtttgattacaaaggagaagaaagaagttgcttaaaatagggtcgtactgaaacaaaattgtataaaaaaataagaaaagaaagagaataataaaaatcaacaaatgaaaaaataaacaattttttacatcctttacatgtcaacagaagtagcccttggactaagaaaatcagcgtcactggacctggatctatttgccctaagagctcatcttttctcttcttctgttctctgtattacagggggcagccccctctggactgtgtttctctagactcccaaatcagccgggctctgggtgggcttgaacagccatttagaagcacttgtgcaagactggaaggtgttaggaagggagaagtcaggggtatttctctccctttctttctgccttgggaagtatctccattgatgactgtcccttttttatggttccattatttccttggttttcttggttcccgggctctgataaccaccatttccttttgtctctcagcctcaggacactaatggcttcttgcttttgctagcctgtaggtcacctcgctgcccccagtatggctcctctattatttcatcatctgtgtaactaactctctgctttatatccctgtgttgtaaacctctataattaaaacagtgtggtattggcccatgaatagacagaaggatgatgaaacaaatagaaagtccagaaatagacccaggtatatatagaaattgggtatatgacaaagttggcatctcaaatcgctgggaggaaagatgatctttagaataagtgatattggttcagcttgatagacatttggaaaaagtaaaaaaaattgaattctatcttatacattatctcaagattaattttacataaatgtaaaaaataaaaccatataagatctagaggaaaacacagtgaaatcccttatatcctaagagtgagggagcctttctaactatgactcaaaatacggaagcaataatggaaaagattgagaaattcaactacttaaaaaaaagaaatggccaaaaaaaatcatcataaacaaaatcagaggacaaatcacaaaccagatgaaaatattgcaacttatatcacaggagaaggtctaatccagtgtttctaaagctcagcactactgacatttggggatggataattctttgttatgggggctgttttctgcactgcagggcattcggcagtacttttggcctctacctactaaatgccaatagcacccctttcccaggtgtgacaaccaaaaatacttccagacattgccaaaaaacgtggggagaggagtgaggagggaggcaaaatcatccccagctggggaccactagtctgttctaatatataaaaagatcttaaaatagtgaaggaaaaattcaaaatccgaatagaaaattgggcaaaagacgtgggcatttcataaaaagaagagaaatggcccctgagcacctaaaagattgcttaatctcactcatactaagaaaaatgcaaatgaatgctattctgagagatttcttacctagcagattggcacacatccaaacatttgaaagaagtctgtgagctacacattactgatggaagtgcaaaatggcaaaagctctttgaaagagaattaatcggtattttaaaaaattatattcagattttcttttgacctaggaaccccacttctatgaatattccccaagagagagagttccaggagaacaaaccaacatatgtacaaggttacttactgctgtaaaaggctgcaagtaattcagatttccatcaatagcaataatggaataaacaatgacatactacccaatgaaataccataatgcagaccttaaaggaagtgaagactgtctttatgtattgataagaagtaatggtcagaatgtattaagtggaaaattcaaggttcagagcagagtatgtgtgtgtgcttgtgtgtgtgtgtgtgtgtgttgtaaaaagaaaattcttaaaaatgataacatagcggatgaatgggaggaataaagtagggaatagatggaaagaagaattttctgagtacacctttttatataattttgacatctgaactatgtaaatgccttatataattttacaaatgaaaatagaaaagttaaatcctaaaattaaaaggaaaccagaataaataagcctaactctattttaaattagtaatacgactcggagagaaaattatttcaagtgacttttggcaaagcattctgattatatttttatgactacaattttaggatatactgtaagcacaaaaagtgattcaaataaattttaaatttcactcaatagttttgttgtattggggacacatgaatgtaaagatgggaacaacagatactcgagactactagaggaggagggtggaagggggcaaaggttgaataactacccactggatactatgttcacgacctaggtgacaggatcaatcatatcccaatcctgagcattatgcaatatagccatgtaacaaacctgcacatgtaccccatgaatctaatataaaagttaaaatttagaaaaaaataaaataattaaaaagtatttaaaaatagttttgttctcattagaacctactttatatgctaggataaaacaaacatgaatgtcttagaaactaagattttcattataaaagaaaagagacaatataagatcaaagttagaaacttataatattaaaatttaatcaaaatccttcatatgcagtaagtattatatatgcattatagatgtataaaatatatgcgtattttttcttgcactatctgttgtcatttattgtaaaacactgaacatataaaaattcacaattttacagtggttgagaaaagaaaacggaaaagaaaaaagaataagatgaagagagtgatagagagacacacgactatcaaagctcactaataaaccaacttttcactctaaaatttgacaattaaaaaaataattcagaatatcgcacctttttgggaaaagctgtcgccaatacccattttattttggaaagctctttataagagattaacagccaataaacgtagaaggaataatattattagagaatcagaattttgcaatcccaatgaaaccactgttcccatcaaggatcatcaaagaatgataaacccttacgtgaaagttcactggggaatacctgatgtcattcccaacagttcatttaccccacagtttacttgctaattgcaaagggcaaacagaccttgcaatgaagtgatctagtagtaaccaccctaaaagtgataaaatttagcatgaccaatagagcgaagcctgatattttatgcttcctaatgtgatgcaatataaggtactcagaatcacctatgaagtaccatactcttgccaaatgcttaagctagatgtgcccaagactttggacctaatatccaggttataaaaagtacaggtataaaaggacaagttaaacaatcagacaaatatagaatgtgatatattttacaagacaattgtcatcatctcaacaaaaagtcagtatcacaaaaataaatgttggtggactgttctagacttaaagaaacttgagtgatgtaacaatcaaattaaataagtgaactctggatcctggtttgaaaaagcagctgcaaggtcattttggggaaaattggataaattagatagacagatgctagatgaaataggctgattagatatcacttgattaagaaattataattttctcagtgtgcaaggtattacggttaagagaatgctcttttctatatgtatactgaaatatttaggagtaacattatctccagaatttattttcaaatttttcagcaagcaagatagaaagatagataaatagacagatagataaatggatagaaagatagatagatagatagatagatagatagatagatagatagatggacggacggacagacggacggacggacagacggacggatagacagacagacagagacagatagatagatagatagatagatagatagatagatagatagataaaatatggcaaatgttaactcttgaatgtaggttgttgggtgatgggcatacgttaattacactgttctttcaacttgactgtttgaaaattttagttaaaaaatgtggtgaagaacattgtacaaatataggatgagatacgatagaacataaagaagacccttataagtgtgtaggagattagtggggcatgattgttattcttagattacttaaggaggcacaaaaaattagtcttcagcagctaacggcatagatatgatagggttgcactagatccaccttctagggccaaaaaggcactggtggagctgtctcagctgtcagtgctaacaacaaagttgattagacaaagatctatggatctagagtgcttggccatgacttaaaaaatagagagcatttaggggaaatattggcagggatagcctgcctcagctattattgttatggcttatggaacatgatgatgggtacagcaccaagaaatcctgtcatcatggacctacaaacagtaaggatttaggctgagttttagcaaagggaataaagaaagcagctagaaacccaagaaggccagtggatccagatgagttactagaatctctttaaaagacaggcaacagacacacagacatgcaatgaattcaataaaaattatatagtcacagcacattttcccagtctcaggaggtttttgccctctggatggaaggtaattgtttgttaataagtacctggcttcactacacatacactagtttcagggtgaaatattactttaattaactagttgaaatttcacaggtctagaatttaattacctgttggaactgtagctaagatatcatggtctcataaaattttactgccttttaaaaatgaccataatttatcagaatcttgggggaaattgtgcattgtgcatgaaaacaacaaacattggaatatagttagtcctaagattgaagaagagacttacaagtacttcgatgcactctactgaagttcagatgagaggacagattctgtttcagtgacaaagacaaactgggtttcatattcactgttgtcttcaccttctgctatagagtttctgggttttttgtttgtttttgtttctgttttgtttttttttcttgctaggctccctcaaatcatgggacagtttctggttttggaccccaaggaaaatctgaaggtagatgaagttgtcctttgtcaaactacccctgctttttttgtgtgtgtgttagctcactttgtatggcatttagagcctgtatgtcctaatctatttcttcattatgcaaagcattgaatagtttcccagattctaattgtccttgtctaggtagcatgtgtaccagggtattatattttactgtatgttgtctctacacatgccgcaccagattaggctcccaggaagccctaaactcttggtgatagtttgatggaggaaggagagtaggatgaagcctttcctagtccctgagctttagtgatctctgtaaacgcacaatttaagagataagacatgtgagaagaagggtaggattaaagatctgatgaattagttgctaatctatttcttaggcaagtaaatttatccctcttggtatgtgtcaacttgtctaggtcacagtacccagtatacacatgtgcacacacacacacacacatatacatactgagagagagagagagaatttactggttttgtatctctgaaaaagcctaatacaatgtactccctcatctgtgagaaccttccaaattcttcagttttacaatttcatatctaaagaacaggtctttgttgctaaattactgcctgaaaatagttaagctctaattattaaggaaaaaaacattcctgtgaaaaatattttctttccacttataatgcaaaggtaaacttcaccagtatataataagaataaattattaataaatggcacctgtactaataataatgctttactatttgttaaaatattccatagtactgaagacatttaactacgttagtaaatgacccaaactaacactattattatttctttaaaattggtgacacagagggatgactaggcaaagcatagaggattttcagggcagtgaaatattctatatgataccacaatgatggatacatgtctacttacatatttgtgtaaacccatagaatgtacaacaccaagagtgaactctactgtaactatggagtttgggtaataatggtgtgttaatgtaggttcatcatttgcaacacatgtaccactctagtgggggatgttcatgatgggggaggctgtgcacttgtggggagtagggaaatatgggaaatctctgtaccttccactcaattttgctgtgaacctaaaaagaaaaaatatgtcttaaaaaaaaaactaatgacccaagtgtgaataaaacatggattacatagaacttaagggtttaaaatcaacttgcaccatactgaaaccacttagggttcttatcatgctgtgtttcttatgattcgtttgtaattagtcagaatatactgcagctgtttgtgatttcagggaagaataagatgtttataaagagaaaatgttccattatctctgctttttaaaattcctttctttgtaaatgatattttatgatatgttttccatcctcatttcaaatcctaaacaagactgttaaataggggtttgtcatacatagaaaaattgctacatattagcttctttccccacttcctcccctagttttatacatccatacacacactcacgcacattatttttatatgcgacaatttctggctctgcataaaatgttactgcaaaagtacactgtgtcaagttttttcagctgcttacattcctactctggtaccagtgccagggtttcagggcactacaatttcctttatatctcagtggttattttgaaattatcatgtctcatctgcactccctcataatgtatgccttccatgtcatattaagctgcactcttttccctgccttaattccctaatttctggaatgatattggaattggttatgattaaaacagcaagggtctatattaaaagcaagtatcttcctcatagatagatcatgaaagtttgaggtaccatgaaatatgatgtgaaaatcaccttcttcaaatatccaagaagatcactagtaaatttcaagtgtaggttcatttttacatatatcttacttacccctggagttccatagcagaggtggtagtgaacttgaccactagtgagaaataagaggaactatggggtaattgttcccaaggaaagggcaggaataggccattatgtgcatgtaactgtaaagagtcagtagatgcatcaagaggtatcgtatgacaattggaagatacagaaataaattcccagggtttcaagataattgggagaggaaaaaaggaaagacagtgtggtggacatcttttgtttttgcttgactagaatcctccttcattagtaacagcatctgagaaactatcccttccctattagacgggtaagagtctcagttgcaatggcccatcctcccctgaccaagaatgtagatttggtccaatacaggcaagtcagacacttcatgggatatgaatctttaactgaacaacacaaaggctgaaattttttccagctgatttatctcaatgatggtgttttaaagagactttttcattagtttcttctccctagatatccctagttgctccagttactgctctttttgaatacttgtttcattttttgttttttttttaaatcctgcttacattagttgcatgcaatcttacaagcttaactgacaaatcattaccaacaaattagatttctttagtgacttggcgaaagtgagaaagaaaactacctttgagaaagggtggactggattaaagaatgaaaactttcagccaaatagtagagaactttgcctaagaatgacttagaactttggtccacttcaaggaaaggaaactaagccagaatgtaaatcaatgcattgcttctttcattgagaaagtcatgtaacaaaaaaaacaccagctgaactaacctggatgcttagtgatgtatttggatttacaccatgctgccagttccttacaatttcagtctcagtaaccctgatctagcttaggttgttttaatccaaagaatgtgctgattgagactttttattggaataactagaatttgacacatgatttccagaagtatagaggttcccagaaaatacataaatgaatggaaagaatagtacagcaggcccttgaataatgttgtttcattcaaatgtcatttcattataatgttggtgaggaaaaaaaaatctattcccagttagagccactgtctgtgtggagtttgcaggttttccccgtgtctggatggattttctctgggtattctggtttcctcccacatcccagagatgcacatgttaggtgaactggtgtgtctacagggtcccaggctgagtgagtgtaggtgttaatatgagtgtaccccgtgaagggacagcatcctgtccagggtgcattcccatcttgtaccctgagctgcaaagataggctccgaaataatagagtaaataattgtctggcttgtttttattaatcttaaatgtatgtatagttcacatttatttcaatgtttaatatgggaagtgttttggtctttattcagaagtttggtgatgttttagtaaccagaaatatgccatagaagctacaattttctagctgaacaaattacagcaatataagctttcttatggttatcttaaaagatcttatggttatctaaaagatcttaaatcacacatcttctttgtgtttctggtatgccaagttttgttgtttatgggtttcaatgtgaatttgtttacttatttattttatttttttacctaagatccaggaactatagatcaatgtaaattaaataaaaaattgacttggattcttgtccttgattaaactgcaattcatgtgtttttgaatttttaaaagtaaattttctgttgtaaagtaataatgacggctacctcccaatgggacacattctgttttctagagtcaatgaattcaagtccacttggagtctatgagtttggatcaccttatcttaaaggctacttggtgaacagagttgaagttttaagataatccgttagttgagttaaaaaagcacttgggtatatcagggcttcttaacttcagcactactgacatcctagagctagataattctttgctgtggacagttctgtacattgtaggatgttttcagcagccctggtctgtatccctagatgccagtagcaatcttccttaattgcccaatatgccctgggaggaaggggtaaaatcaccccaagttgagaaccactggtgtatatcattgctataagggcattggtttttaaacctgacaaagctgagctcacctctcaggtctgtccctttcttacgttgatttgggaaagttactattttccttgtctgagaaatgttgatatctcctgggaattcttgaagagattagaaaatgtacttagcttcatgactcacctatagtaaaaactcaacaaagtaatcattgttagtaatagtatcataattcctaaatcctaaatacagattttctgatctaaatgtgcaaataataactaatcaaatttccaactgtgttatttgacaaaggtataatgaactaaaactctaagacatgttaaaaaaaaaaccctaaatacaataatttctaaatgggacaaaggctttatagctaactctttgaacttgaaactattttcagaaaaatgactggagtaatgttgctttccatacataactgttgaggaaatgtactaacacagacgagatcaaactgaaaaagaattatatgtccaatgttctagtcctagaaagaatacacacacttcctctctcttcctctaaatccatagatgttagcagtgaaagatactaagaaaatgaagaactagaacgtggaatattgtcacatggaactaacataagaagtaaaatgtaaatgaaggaattttatacatgtgcatttcaaatgatctcgaccacaaaatcagagaaatgacagacgaatacatgaattatcaaaccattcgctgttcaaaaataaacttctgaactttagtgtttgcttaatggaaagttctttcttttctttactcagttatgacctcagacatgcatcagaactcaatgcatatgataaaacattatcatgccaactctgtggatacgaaaaaaaatgcatgagtggagtgacatttaaaatgctgatttaaattccttagcataaatttcaaccatctgggaattttatttgctttcctcttggatcctgttgcacactcaggtgagcatagctgttatccataaacgaacagttgttttgaaggggcagttgtacagtctctttaataccaagttcactttatctggggtgttcagatagtgctttcattttcaggtttgtggaaaggtgaagagacaaaaagctcaaatgctttgttaggaaatgctgctgaggaaaggaatcctgattattgctttgaacttcaaagtatatcagtaacagggtctcttaaaaggaagtctcttgagagttcagattacagtgaataatcttagaaatgttcctgatgaaattaaattgcatggttcaagtaatgggctactctcccatatgagccttgccatgattaaaactgctttaacactaaatcgcacatggatgccttgtaaatacaagatatttaacaaatatttctcttgatgacagtctcatctcacctcatttcagcaaattaaagtaagttgccacggctttaaagaagtcacacagctagttaattgcaccgtttgtccaggaaactcattctcctgaatcaatcccagtacagctctgggttggattgattaaatcatggatacattgattgttttaatgaaaaaagtttacatgttcatttaatctaagacaacctgcaccttacacacacacacacacaccccacccacacacctatcttttttttttttgagatggagtctcgctctgtcgccaggctgaagtgccgtggtgcgatcttggcccactgcaacttccgcctcccaggttcaagcgattctcctgcctcagcctcccaagtagctgggactacagtcgcgcgtgaccaggcccagctaatttttgtatttttaggagagacggggtttcaccatgttggccaggatggtctctatctcttgacctcgtgatctgcccgcctcagcctcccaaagtggtggattatgggtgtgagcctgagttaactaaaatgttgaaaagttaagggaattggtcattattcttcagcatatcattcttgaacaaaatgcggtttctattatactctggcttttgtggggctagcagtatctgaagaaacactgcagaaaacattgtagacagttttatttcctaggaacatcagtaagatttccacaatataaaaacttaaaaaaatattcagagcaaaaataattaaactaccataaaagtgttctttgccaacgaattgtgactagtacaaagcattcagtcataataaatcttttaagcttttcaaaagcaactccagaagctaagtttcaaaatttgtttagacaaaagcaaatttttaagaaaaagagtgtatattttcttcaagctacattgaaggcatttgcatgtttaagtaccagtgaaccatttgtttatgtttaaaaatgtttaatcacgttagtgtttttttagtttgattttattttccaaagatggctacaacaatatctcccatcccatactttcttctagaatcttgtaaatttcccattaagaaatacaatctgattcctgcccccttaaacctggacaggtttgtgacttgcttgtaacaacaatacaagatttcccaagctaggtcagaaaaggtagtacaactttcaccttatagatggaatactcaggccattcctagcctttccagatggcaaacaattctttaattaaaagagagcctcaagtcaaagatcaaatccagggtgggactataagatcatttgtgaagacttcaaaaagatctaaggctatacctcatagatcatttaagaaccacaaaaggctctctgaggatcttaaaaacatgcctcataggtcctccctgttaaacaatatagggtttctaagtatctaaggaagtgtctttcatcagacttacagggaacacaaaatagagaatggattatcttaaagagatttgtgactgtggcttttgtttaatggactgaaacccaatgagattcatagaaaatccacgaagttcttaagaattgtgttgctgaaaacactgccagtttaaaagagaaggccgggcatggtggctcatgcctgtaatcccagcactttgggaggacgaggtgggcagatcatgaggtcaagagatcgagaccatcctggccaacatggtgaaaccctgcctctactaaaaatacaaaaaattagctgggcgtggtgacatgcacctgtagtctcagctacccaggaggctgaggcaggagaattgcttgaacctgggaggcggaggttgcagtgagccgagatcacgcactgcactccagcctggcaacggagtgagactccatctcaaaaaaaaaaaaaaaaaaaaagaaaaagaaaagaaaaagagacagtacaaaatgaaaggaagcctctgaattctagaactgctataggcaggaagcaaactgagaagatttagttttatgcataggtcacttattataacaataaagaaaagattactcaaagaaagtaagactccagagggcagagccaaaagtcgtggccaactctcagagagtagaaccaaaccctactgacaaaactggcaacacgtacctggctggacttcagaatttctattggccagtgacttctatgtacctatactcttccatccatttgtaatggaagcatctattgtggttaacctatgcgtctggcctttacatgatggatatgtgggaggcaccaagaggaacagtacttgaatgctttgcttaaggaaactgacttaaggagactcaactgcaaaaggacctaacttaattagagaaataaaaggtttgcttctcgaggtctatttacagactaagaattacaaaataaaagatctagtgtatgtggattaataattttaataagcgaaagtggtatgtactttctaaagtatatcacaaatgtgatataaagagataattgagaggcagaataatgtgttggtcaaagtgcaagccctgaatcagaatggatggaatcaaatcatggctccactcacctctagttctatcaatgaaggcaagtcagttatatgctctgtgctttcatcccccatttgtaaatcagacatgacaatagtacttacctagggttgttgtgagaattaaattagtgagaatatgcaaaacatttagaaaagttcttaataattatagagataatttacctacaaaaatctaattgacaatgatgacttttattgctgaaaggaaggaaacttttaactcctctcaaattactgggagttcaaaaatgaatcttgttgagtgaagaaaattgctacagaagactttggaagtgattacacaagtacaacatagtaaagctagaatcttctgccacttgtcaaaataaactaaaaatagatgaagaataataaacactaagttgtgaatcctagtgtctacttacgataatttaatgacaataaatctaggcagatctactgggttatgctaagacattttcctagctgtatctaatttgattgactttttctgtttaattagtgaatattataattatgtgttctgaaagttgtatgaatttcataccatcaaatagcactaatgcaaaatagagcaaaatatcaagacttagagtctcttttgtgaacttgccttcttgcaaagaatatagttaactccctggagtaatccttatttgtctacataatgaatgctgtgggaaaatgaggcacttccactcttgttctcatcggcattgatatgaccttgtctgatttagttgaaccaagggcattttcaataattacaagctcagaggtctaccacagatcctctcatgggaggattacttaatgtaggcaaagtagatacaacccttcatgtctggtccattttaatttattggttgcctaaatattcaatcagagctttcaccagctatatttgtagagctgctcaaatgtttttataaaagtaagcacatagaaattacaaacggtgcttcttttcattcttgcaggctgacacctacaaaatatattttgttaggttataaatagttaaaaaacttttttgagctacaatgcttttaattgcttaattttgtagtttttagaaacatgttctagaaatatttaggaaacaatatcacatcctgtggcatcaagaaaggcaggaactttgtttttctaattaataaagaaggctaaaaagagtcagttgttaaataggcaatgggaaaccataattgtaatccatgggaaccacggatttttgctggaatataaaggatgatttaaaattagcttaagatttcactgattcttaatgtattttgttgatatattgattagaaaaaaattacatttagccacacctaaacttattttggcttgtttatcaaattttcagattaattcttgttgatcagtttcctttcctccttccttccttccttccttccttccttccttccttccttccttcctttctcatgctccacaacaaacatttgttaggcaacagttcatttactaacaccataataggtgctagagattccagtagaaatcataatctctgtcaccatgaagttcatgaatttacaataaaaacaaaaccaattaacaaaggtgggccccgaattcaatgactggcctccttataagaagaggagaggatacagagacccagagaagaaggccatgagaaaacagaggcagagattgaaattatgctgccacaagaggaggaacacctggaagctggaagaggcaagaaaggattctttcctagtgcatttggagggagcatggtcttgctgactccttgatttcagacttctaggctccagacttgtgagagaataaatttctgttgtatcaagccacccagtttgtggtactttttgtggcatccttaagaaacgaatacagacatgttcactttgaagtacctttgggacaactgagtcgaatggtcaaaagaaagatgaattcagggatttggaattccagcttaggctggagataaaactttgaggattatcagtatgcgatttggcaataaagccatataagtggctaagatcatccaacgcactgtgtagaatgagacaagaattccatctagggccatgaagaacagtaccttttaggaagagaccaaggtggaggtgctcacaaagggagactggagaggtagaaggaagaccaggatagtggaggggcacatgcagagggtttcaagggttaagtgcagcagactggtcaagtaaaataaagactttgtccgttgcatttaggaaaaggcagttgtggtgacctaactgagacttcagtgcaagagtggagtaattttcaggaatgactgagagatccaaaagtgagtccaggaagtgtagacagctctttccaggggattgaatgtgaaaggtggaaaaccgactgcaactagaagcaaagaatgaagaagacctttcacattgcttaattgtcactatttggattttcttacagatgattatgctcttaactaatgagacactttgatgtttagacaatgatgataaaacaaaacagtacctcattttaattgttgttgtccacaaaactgctcactaaattatggcaaagcaactagaacatgttttacagatacaaatctaaaaagtcagtaaatgagaatctgttgttggtagaaattttctgcataatttacaaagagggaaattataggcagaataatgttttgaaatgcaaaacatctgactcatagtagagatgaagagcagtgaatgacccatgagagaaacttatcttattgttcacacacagggtagagaaaattcaaaccgataaggcatcaggcaaagcaaaactgctttaacgaaggtgagtcataatgccactcagggagatgaatcaggtgcccacatgtccaatcactttcataattacagctccctacatcttttaaattaaaactgaagtcaggtaacaactaatgtccctttagaacaaacttagccaaatggaaatagacagagtcctaagaagtaaaatgagcatatcaaagagatgcagcttttctggaaaggaaaaaaagaaagaggggcagtggctcacacgtgtaatcccagcactttgggaggccaaggtgggtagatcacttgaggccaggaattcgagaccagtcaacatggcaaaaccctgtctctaccaaaaagacaaaaattagccgttcatagtggcacatgcctgtagtcccagctgctccagaggctgaggcacaagaatcacttgaacttgggagatggagtttgcagtgacctgagatcataccactgcactccagcctgggttgcagagtgggactctgtattaaaaaaaaaaaaaaaaaaaaagagagagagagagagagcttgcacaaaagcaagccatccctttaagtgtaatgtcatgactgctggccccaaaagacttttaaatgcttttattgtgccctctgttccaactgattttgataccttcccatcatggaatcactacagtagtttttgctcaacatgaagtcttagatatattatacctgaggcccctaaggtttcctgctcaagccaggagagtaagcagcctccctgccccctcccacccacttcccttctagctttcacagtcaatcaaaagcctagtaaattctacatcttagacatctaccctctgtcctttcccagagatacagcctgatctaagctgctactgacttacctgtaacaactagtttcactcatcctggttgcctcctttaggcaaagctacagcacagctagcgtgaacatggaaacatacaaatcagatatcattctgttgcctaaaccttagatggtttcccgccaagaccaacacaagcttatatgagcctctgtgagaattttgaaaaaaaggtaattgcccctactatgggataagcagaaaagagccacatttcagacccgatttaccctgtggttaggcttatttatgtggcgatgaaaatgcagcagacgttgcctgtagaataaaatccagactctttaaaatggcttatgaagccctctacaacctggcccctgccaatctctgcagtcacctctcaccattctttgatcttgctcttacagatcagtttcagttccttgaccatatcatgttctcacttatatctttgccaaacctgccactgtttggaatagtcttccctcctttgtgaccacataattcctgctcacttttcaggttttgacaaaaatattacctccctttacaggtcttccccgatgcccttgattaaaaatgctttcttgccatacactcccccagatcacctaaatgtgtccttgcataacagtcattaggattcattgaaattgctggcataggctgagtgcagtgcgcatgcctgtaatgccagcactttgggaggctgaggcaagtaaatcacttgagcccaggagttcaagaccagcctaggcaatgtggtgaaaccccatctctacaaaaaaaaaaaaaaaaaagaaaagaaaagaagtaactgggcatggtgttgcatgcctgtagtctcagctactcaagaggctgaagctggggggttacttgcgcctggaagtgtaggctgcagtgagctgtaatcgtgccactgaattccagcctgggcaacacagtgagaccctgtctcaaaataagagagaaattgctggtataacgtcaacattttctaatgaactctcagctcaaagagagcagagattttgtctgtttgctccccactgtattatctgtatatagtaatgtgtctgatgcttagaagctcaagaaatatttattgactgaataaataattacatgaataaaaaagcctggaatccttgttacagtatagtgggaagaggtctagtccaggctcttccactaacttattggttctgtgactgtaaacaagtttcctaaccacggtgagcctactctttaaatgtaatctttaaaatgttgacaataccgtttgtcctatctaccatcaaaattgtcatgaggctcaatgaagctgaggacaactaatgtgtactgacagcctaccacgtgcaaagctttatgctaggtactgccatctgtattatcttgaaaaatagaagaatctctgaaagactgtcatttacccaaagatcatttttcatagtaagtggcaaactaaagacttaagtaggaatttctgtgattccaaaggctcttttcttctcgtcccttcccttcctttccctgccctgccctgccttcccctcctctccctcccctcccctcctctcctctctttctccttcctcaccatgttccatcaatatctatctgattaatacttcaagtcacaggacaagcatcactcgttttgtgaaaccatctctgattcttctgaccagatttatgtgctcctataactatgttcatattgtacttactataataacattagttttaaatttttttttaccacaaagtttttgtgagaggggagcatgtcttcccactattatattatttccagtatcttgcctggatattaacattttataagtactaaaggaatatttgttaaatgaatgaatgaacttactttctctggcttttttagaaaatttgataatacacctaatttttgttcagtgtttacagttttatatttaatttataaacagcaataattgaggccccaaccacagtagctcatatgcttaaagttgttaagatagtattatgaacatacgacatcagctcttgcccaataatagacgtttggttttagattaatatatttaagattaatcttaaagtgcaactaataggctgagtgtagtggctcacgcctgtaatcgcaccactttgggaggccgaggcgggtggatcatttgaagtcaggagttcgagaccagcctggccaacatggcaaaaccccatctctactaaaaatacaaaaatcagctgggcgtgctggcacgtgcctgtagtcccagctactcaggaggctgaggcacaagaattgcttgaacctgggaggtggaggctgcagtgagctaggattgtgccactgcactccagcctgggcaacagagcgaggctgtgtcaaaagtaataataataataattttaaaagtacaaataattattgcctgaaagggaatatgctaaatatgagatacagggaaatgattcaggttcacttcaaatttaatattccagttttaatttgatataaggcaacctcagggaacaaacatgttgttagtagcaaactacttagcttagagaacttaacatagtatttattgtaatgttcccctgttctagaaaatcataactaataatagaaataaaacccagctgcatatcaatggccaagaacatatcaatggactagaaaatatgctaaggagactaaaacagacctgaacatttccttcaaatttaaataaagtaagtactttttacttattactaagatctgaaagatatattaaaaatactttgaaattacgtaacatgtgatctaaattgttcatctaaaacaacagcttgtcaaaatgctaatcactaggaaccgagaggtttgtttagttaatagtgcttcctttcacatgtgcttatgtgcttttcagaaggaaatctgaaatctattattagctttccatagtcaactcctgattatccgagttaataaaatagaacccagacatctgtgctaatagagagaacacagacatacaatagacctgattcagatccaaaaaagcagataacacaaaaattacatctttgactccggaataaatgttgattctttgtagcatatgtgccttcctaataacactccattagtttttctactatagcacaggggaactatgctacggaaaactcacctacacatgtaagtgagagttcactctagattgtgtgaacgcattgttagatgttagaattctgtcagtggtattcattccgcacactggattctgatcatcactaatatgttgaaaggtctcattctcttcaatgctccaggccctaatacaagattcccaacctcataaatggctcctgtagaaagtaacaacatcagggtgaagaaaaagtcagttatgggaaagaaaaaaaaaagccatgctatgctttgttttgacctcgtgaaagaacagggatcactcaagtttttactgttattttcaaagtcaagccttagatacttgttcactaaaggggaagaaaattataaattattgtacattattagatacatggctttctagagtgaaattaatgattttggaaatgctgggccaattactttataaatgtctaagaaaaatgaatatcttcctcatgtaaataactgcaatcttttcatctgtaaaatcagatcagttatgtaacaaaaacttacattaaaaatgacatatctccctgaggcaacttatgaaataacgaatgaaaggtaggctcatgcttccgaagaaagcaatgtagttcagaaaaaactacagagctcaccttactatatacatagcaataggcacataggtggcagaatcccagcaaagcaaatattctttcagtgattcaataatttgccatttattgagcacctattataaggtcagtcatcatgctggacactgtggatacactttatttgagacatggtccctgcatttaaggagctcacagacatgtaaataattttgtgtaagagatgcaatagtcgaagcatgtgaagaacgctagggggagtatggatgcaagaattggtgggagttaaagaaggcttcacaaaggaggttactggcatagacataatgtttgtaccctcccaaaattcatatgtttaaatactaactcccaaggtgatgggattaggagtggggcacttgggaggtgattaggtcatgaggacagagccctcatgaaggcgattagtgcccttattaaagaagcctggccgggcgcggtggctcacgcctgtaatcccagcactttgggaggccgaggtgggtggatcacaaggtcaggagatggagaccatcctggccaacatggtgaaagcccatctttactaaaatacaaaaaattagccaagtgtggtggtgcgtgcctgtagtcccagctactcgggaggctgaggcagggttgttgcttgaaccccggaggcggagattgcggccactccggcctgggcgacagagtgagactctgtctcaaaaaaaaaagaagaagaagaagaagaagcccaagggagctcctttgccctgtccactgtgtgagaacacagagaaaatgctccgtctatgaaccagaaagtgggctctcaccagaaccaaatctgctggtgcctcggtgtggcctccccagcttctggaactcaggaaagttaatttctgtggtttgtaagttacccagtttacggtattttgttataacagcccgaatgaactaaaagagttgtctttagccacagttcatgtaagaattgtaatttaccaagtagattagatgccaaggcattccaagatgatgaaaaagtacttaaaacaaggagccatgaactctaagaacaacatacttagaagtccatgatatatttggatagaggtgaacaggaagttatatccaaattatcaaggactgtgttgagcatgctaagacatttggatattcttatataaaagttattaagcagggacaaagcataagatgttcttaaacagcggaatggcatgatcagatatcctttttaaaaaaataaaaataaaaaaagaactctgttagctttaagagactgtcaagtcctggaggtgggaagcctaaatgagagacatcaatagtttatttaggtctggatgatccctaatatagtctcccaccctctgtcttatgtcttaagatttcattatcagagctttagctttataatttagtacctattaaagtaaaaattggtattttgggaatgataggatagaaaattgcataagtggttaagttgagcttggggatgtggggcaaaggtgacagttttaaaatccttccctctttattgtgtaatctcaaaaagatcaagggactggtattgatgggagaggcaccttgaggccagagcagatggagagagggacagacactctctttccaaaatcagaggagcatgggatatgtttgttttctgcctctccataatatggcacaacgaacttagtggcttacaagagcatgcatttattatctcacagtttacaagagtcaggagtctgggtggcttaactgggccctctgctcagggtctcatttagatattggccagggctccagctctcatctgagggccagggtccttttctaagctcacagactgttggcccaatttgcttccttgcagctgcagagctcatgtggtttattctccaaagctagcaacaaagagagagaaattcagctgcatcaagttgctaacttctatgcccgaaatttaaggaatcagcttattatcagttcatctctcttttgattaacttaaaaccagtgattggagaccttaattacatctgcacaatccattcacctttgccctaaaacatctgggagttatatcctatcacctttgccattggctagtagcaagttatgggcctcacacacactcaaaagaaggacctcacacaaaggcctggagacagggagcaggatcacagccttcttagaatcctgccaatgacagatttgaagagttgaggtcactagagtctaggagaggcaaggaacaatcagtctatccagtaggtagaagtaactggggagaatgtctggaacaagttctgttacaggctggctcactgtggcatgacacctaaaagtgaagcctgcgtttgaagggcctggccccaggtaaacacatgaggcacccacccaacatagacaagtgcagagagcaagaggggaagatgttctccccaaagaagactgtacagatagaagatctgaatagagaaaaaggacttgtagtttgaaaactgttttcaactagggggaaggaggggattttctccatagcaccaacctgggaataccaaaagactcttttcctccttttgttttaatttttcaattaccgtaagcttttctctcacagctttatttttaactttaatgatcacacatatatcacacaaatataactaatacgcagggagatttttcaagagatataaacatcctggttgagaaagtcaggagagaaaaactactaagtaaactaaaaatgacaagataattagagagaagatatatacagcaataaatttgaatttcaaagaaaatttcaggtaacaaatctgttatattttcacgtgcattaatagaagttaaagcaagagaaaattgagttaataaaaaattgatttaaaaaaaaacagattttcaacacaaaatctctctgaaactactgcgcccttgcctctgctgtaattttggaaggattagcgcttgtaggactctggctgtccccagcagtgacacaccttcccaccccaggatacataaaactggggcacagagcagatggaattttcagctctgctcatcagcaggttgacctgcttgttccaagcaattttgtgaatttaagactctggtgcctggctggactcatagcacccgggtgctctgcaatttgtacagaattctaaaatttcaggctctgcttgttgcctagatctttagtaataacagcaataaaaaagtaataatacccacatgtattaagcatttatgaagctacattaattaagcatatgttgtgtttatgtagtttgcagttaatggcactggcttaatgtaatagggatagtattttttaaagaagaacttgatatatttccatcttcaaattgtgtttcactggaaactgctcctcttccagggctggacagggtacctaatgccctcacggaagaaaaggtgggttagcaagtcaatagacttaaaaatcagagtcctgctttagaccaatcagaatgacgtatgaagatctattgtatagacaaatgagaagcccatcccagaagagaaaggacataccagcttctggagaatttcaaaacggaaaaggctgaatgagatggggaggatagggaaatagttctacatttgtgtctggaactttcctttctgggcactggcctcgagagaatgtagcataataaataggtattgggcaaacataagaaaagagagctctgggttcccaatcccatctagattctgggcagggccacatcccattaaacttgatagttccctgtggtaaggactagcaagattttggggataaatctttctgagtcccactgatattcctaaattacgaatgagacccagaggtacctggagcctccagaagggggcctcagcaggcagctggtctgaaagccaactggactgccctggggccagcttggcaaggggagaggtgaccgctgcagaggctaggaaagacagatggccgacctggcagagactcagagggaccactttgccagtgcgaggcgagctgaggtgaccagccagaaagagctccaggctctggccagaatggtcttgacctaaatatgccacctgcaggccacaggtatactggaagggatgcccactccctattatcccttttcctgtgtgtctctccggccccatgtaccagccattcattcgttaggagtttgaacaaaaagctaattcaaactttctccatcctcctcaaatatctcatctttgccctcttttgttactctccaaagacagccttgctcttggttcacagagaaaataagagccaccggacagtaaaatgcaaatcagatcatctctcttcgtttaaaacacctatcaatgacttctcattgctcttaggataaataccaaaatcctgaaggtagctacaagggtttgattgggcttttactcgctttgcagcttcaactgctgtcatttctctcctttctctctgacctgcagtttcatgttaatttctaccacagggatttttttaaatatgctattccttctttaaagaataatcttccttccccaccttggcctacttaattcttctttgtctttcagagccccactcattgttggcatgagatcagtcacccccttgagatactctcacagcactttctcatggcacaccctgagtaaacatatttatttaatattgcttaggtaagccaatagtattatatcaactaatttcatttggagtagcaagtcccatgcactagctaactaacatcaccccattatctaactatatattttcataattttaagtgctgaaaagcaatcaacttttcttcatcaagcatctcgtaacctgtaccttgccttctacctgatgtgcaatttgtcacaaaggcactgggtgaaagtcatcatgtgacaccacaggaaaacaggaaaaagtacaggagacacatttcatgatttatcaagaagtgacaagaatataatttaccattacatctatatgcagcatttgatataaaaatacttgcctctagggtacctaaaatcctggtctattgaaagtactgaacttaccaaccaataactcagctaatatatttaatgtatatatttttaggaaaacaggtcccaaagatgtaatctcgcatcatcctctctaaccctttactttctccatatcagcttgccccgaatcttagcttggagttgagaggtcatctcagcagcctgttcctggccttcctgtcggctggaggccaaagcctccctcagctgcctgtgtccagtggctgctgtaataatgatgtctcagcttcaggaggtctatttccaggccatgtgagctaattaaaacacaggccttcatttgcctttctggcaatccctgatcagtgtgagaggcctatgccaccctctccattctaattttagttctcctctagtgttttctctcctttgcagaaaagcgtcctatgctgctaagcacttacaggcttttgtttttgttatttctcccacttggaaagaagcacttttccactttactccttttgggttttctcctcccatcagttttctcctgcaggaggtgatggtttgaaactactagcaaaactgaagataattagttacccaaggtagttgacttgcttagcaggtgcccttgagaaagtgctaatgcacaaaattcttcatgtggaaacaactttttggacacagctttctataaagatagagaacacctgttatcactggcgatgctcagcttcttttcccccagcaattcacaacacaactatccagagttcagaactcataaattcactcacaataggctgagatgctatttttcggtcttttaaaacggatactctttacttctgataagcataaaattatcacatggcttcctcccaccctaccctccctcactgaaaaaaaatcattatctcaactatctactctacatatctacttgaatatccaacagattttcaaattaaaatgttcaaaactgagatttccccatctccactaatatcagctccatctttccaaaggtcaaaacaccaaatatctttgaattacaactttggtcccttttattttcttatatcctacctccaattcatccaaatatatatgtagatagattgatagatcaatcgatagacagatgatagatagatagatagatagatagatagatagacagatagatctacctttaacatagatccagaattctaccactcctcaccacctctatttaaaaaaaactgttacccgaggaaagaagaacacactggcaaccattaaggggacccaagagattgaaatatcttagcagatgggttctcaggtcattcaaaggtttcacatgagaatgagacacatagtggccatgtgcagagagagccccttagggaagtggccttgaatgaaacacctctcttagggagactttggcagccagggaatgacatgaggagccttggcacctcaaggaagagtgggacaaagtatagaagaagtgaactcagataaaggtgatctatattacaatgtgttaaacaaatggaaagattaaatattatgaacgcagtgaatgttatgtctttagaagtatcaaacatttcttccaggaaattgttgtactgatttaattgcagtatttaagaatatgttgatggaggagaggctaactcagctgctcagtcccatggtcttaagacaattgctgataattataatcattcctagttccttgtgcatcccattctttgaatccaacaattattccaaccctcttctttaataccttgactccagcaatactttgaccccactggaatctccagtcctaagatcttattgatttttcagtgttaattatctccttgttctctttcacttccctcttcatcttgaagtctatggttaaatattacactcccttgcatttatatttccttgctcttcaatcacttcaatataccaatttagcaaaaccacaacctatgtaaaattcaactctccaaatactctgcacctgcatcctccagctgacataggctggagaaaaacacagaaccacattggatagtctaattctaaatgcatgaacacagactttaaataggcctttaatgctgccaggtgatcacatcatatacctcctttgtccactcactgtttcttctaaacaactatttcacactgttctctctttcctcaaactctacatttccttctctgtctttggtttcaattgaagctgctgctctctactttgtagaaaaactgaaaactatcagaacagatcttccccagattcccaccacatggatctcctgccagtatttgcacccacaaccaaaacatctgttcatgctcctgtccaaaaccagtctctccacttggttaataatagaattcatcatcccctctttctcctccatcgtaacttaaaaattcccctgtgaagaaattccttcaagggtagtctatcattactctaagtcctctcctccctttctcccttaaaaccaccacatgaggctctatcatttccaaccaaattgctcttgtcaaggtcagcagtgacccccccacccccaatattgttaaatccatgaacctattctaacttagtcctcatcctacttaacttatcagctatatttgacagagttgatccctctttccttcttaataactttcttcacctgacttcagaacaagacactcaccaaaagatttccttctatctcacaggttgctccttatcagcttcccttgctggtgctgcctttcattccatccttcctcaagctcagttattggtcttcttcctctacacacgctgcatatcatctgtataatgacgacgttcacatctatacctgcagactggaccttctgctgcctacttgacacatctattcagatattcagtaggcatctcaaaattaactcctggtatttctcactgtttaccaaaccttctcttccccaaatctcttgtgtgtcaaacgataggaaattcattcttacagttgttaaggagaaaggtcttggagtcatccttaattcttctcattttctcatataccatgtccactccaccatgaaattccattggatctgccttaaaaatatgtccaacatctctccatttctctctaactctgctgattcacctgtgatcttagctgctttccctctcttactgcaatgctacaattgccttctaactggctttcctgcatccacccttgttccctctccccatccatgatcgacattatagccagattaatcctcataaaatagaagttagatcatgtgacttttcttctgaaagaactgaataggctctaagaaaaatcactctgggttaaagccaaagtcctgaaatggcttattagggccttacataatctatccctcaccctctcttcttacctacaaatattctacatttcaaggaagagcatccacctttcactcatcagcttaagctagaaactttagagccctccttgaaatatttcccctcatctttgcacatccaattaccatgacctgttaattactctttccttgtatctcttaaaccaatttacattttccctttgctatgaaactatttctccccttctccaatgtcatttcatctcaaatctactacatattaatactagagtgaactttctagttaaatgtgaacctatttatatcattccccagactgtataacaccaaagctttttaattctaacaaccttttttgatgattcacaagttgaagctttaatcacaattcaagctactttttaaatggccctctgttataataaattcattggttcacttaaaagtgttttgcagcatacgatttatttttgaagatgtattagtctttgttctgttaaatgccattttggtcaagattaattttttgtgtatgcaatcatttataaaatgaaatgtagattaatcagtaaatttaaattatacttctaagtcaagaaaaggtcagctatctcggcataagcttggtcagctaccttggcataccttgtacagacttacaacaggcccccctatcttaaagctactacagatttcaaataatagtattaaaaacaaaaataatattaagcaataactgtgataatattaaagaataatattagttgccaaggtttacaaaatgtattaacataaactcatttattactacaaatacctaaagagtagatattatttccactttcagaggagcaaattaaatgtcagaaaagttaaaggttttgatggaaaatatctagcaaatcagtgatggaactgactcttcaactcattctctttatatacccagtggcaatgtctgtaaagcataacaaattaaatatgtgtaagctaataaaatgctacttttgcaagtacaaatgccttccttacaagttttcctttttaatgtaaagcaaagcaaattgtgctttcacattattactaaatatcagtctatcctaaaattgtttatgtaatgtggaggtgatatattatcttagaaaaccactgtaacatggtattggaaaccatttcaactgttaaaaggttagatttcagttctgtttaaaggtcagacctgaaaatatcctgatgattacaatttctccacacattttggatgatgccactgaactcctggcagcagcaaaatgtgtttgttctgatcctctgcttctggtggtcagtttcagagtggagaaaaggcgccagggctttgggactagacctaaatttctattgcttttaattaaaataataaaggggaaaaggtaatattcctatccaactgagacagaaaaatttgttgaaaaccgattcttacctgttgaaaaatattcagaaaatcgatcatccccaaaacaatgtactaactaaaacaaaaccaagaaaggcattctgaaaggcaagtatcaaagcatctgtcattgccccattttaggttttcaaatctggaactagtcattcaaataaatattgtttgaataataattatatgcccagaacccttcccaggtccacataccactattttttgtttttacaaatcacatctcatctctcctgtcctataaaactgcatttagtacatagcagacaatacattttaatgctcactgaatgaatgctaggattgatgtagaatacaaagaattatgttaatatcattgttattgctactactactaatagttactaacatttattgagcactaactatctgccaggcactgtgttagtcactttacatgcatcaccacagtacagggtaagttaatctaattaattcattgttaatctaattctatagtaagaaaactatagcataaagagatcaagtctcatagctaggtaagaggctcagtttcacagttagtaatcaaactttggcagtctgacctcagtgcttacaatgggccagagaccaacctattgcagcttacattctagaaagacgacaagaaataagtaaagaagtaaccaatataattttacataggagataaggctatggataaaagaaaacgggatgatttgatagaagtgactagagtgatatagaaaaatggttaaaaacatgaactctagtaccaggtttgagttcataccagaactttttccagctttgtcattatgggctgttatttagttacttatgttctttgtgtatttccttatctacagataataccgaatttatataacagtcatgaggtttaaatgaattgatatacataaaatgcctaaaacagttcctgacacatagtgtcatttaagtatttattattattgttatttttgcatttttattgttataattcttatcacgttgaggacatctacttgagatagggtggtatgggaaggcctctatgaggaaatgcatttgaaccaaaacctaaatgacacttaggcacatgaaaattttaaggcagagattccaggcagaaggaaacaaagtgcaaaagccccagggctagaatgttcagcaaagaaagccagtatggccaggatgagttcagtcaagttacagagctagtcaggaaccaggctaaattaggcatcactggatatggtaaggagttgggttttattctaagtgcgattagaagacatgggaacattttaagcatggtaatgacatgctttgatttacattttataaatatcactccggcttccatgaaagtttggattataacttccatagaatgtcaatcttatcattcccattagtcattgtttttaaaatcttagctttattcctagggaaaagtaattctctgactatatttccagaatgtttgtgttagtgcttttaaacatagagtccgattaaaggacttaagtaggtatatgaacatacatatatacacatacactcactgtgaacaaagattatatggaatactcacatagaccacacttcattattctaaattcaaatcagaatttgaattcactgaatgaatgctaggctgggtttttgaatcatgtttcttggaaggaaagtaattgtttacttacatgaaagttgaccatatgaattaggtcattcttgttatacccaactaaaacagttgagaggtcaaggggagaaaacatctagggcacataacactgttccaacaatgtaattccctgtgagcttggctgctgaagctgcctgctgtaacctgaaaccagttttatctaatagctactgaaacaacctgctgcaactctgagaatcattttacccatagccatcacttaccaatcaaaactttccagctcaccaacatattattagtgccaatgaacttcctcaaagagcaatatgtaactttccccttttttgtaaaacctctatccgtctgttctctggacataatgaagaccatccagcctatgagtatgccacaaatgcaattcttgatttccaaataaaacatttaaaattaagacttttgtctctatattgtatttgtctttaacccttattgtaaattatatggcaggggaggatattctttgggtcccacttctcttatttctaatatgtcccttggccttgccaggcgttagctccttgtcccccaaataaagaaagctttgcaaatctgactgcatggaacaatgtatgttttactagtgggtggtgttatttttcttaatcttaccctcacacccagcattttctcccccaacacacttcctctgcaagttcaccatggtttaaataggttgaaagccagcctaggccacattgtacaattccttcttaccagacatccttgatataagttctccggcttcaaagcatctcttaataaagttgtctgttgattagttgataccgctgtgtggtgaggggtaaatggcagtggaagaacatttccaggtccctggtatttttactactataatcacattaaatcatcatctttaatatctaacaccaaaaggccatccatgtattcaaaaagaatattacagccacactgacaagaatcttaaagccctacattgccacacatggaggtgaactaaaaacacaatgcaatttgtacgaagactcctcctaattcctctaactcataaatacttcagtcttaaaataaaaatacagctgcataaagtgaactgctttacctgtatggttagttccctcattcttgacttctgtggttcccacagaagaggtgggtggactagcaggaggactggcagtaaagcttgtgcaccctgtagatgtgttgatttcaaaatattcttggttgtgattcattcggtgaaaatccagagaagacacaatggatgttcgctgtttaggctaaaataaatgagcatgacgagagtattaatatgatcatgttcatcttcagcccaatctccccatcaatttaatctaagtgataatttttttcagttaaaaactatctgggttttatacttaaaatataattgtgctttacagagatacattaatttcttgatgaattaaataataaaaaattatttaatgagaaaatattatggcatagttgatgtgataggttaggcttttcatttgctttccccagaagattgtaaaaatatagtgcacaaaatttctcttggtaatcaattttgaaagttgcaattttaagtcacctttcattcaactaacatttattaagcatctggcatttgccagacccagaggatatagaatctaataataaaagggccttacaacatagaagaataattaaggcagttccatttttttattctttaaatagtccaaggaattggtggcattagatattgttcccaagtacaagatgctggaattttatcatcagaattaaataaagttatatggaacattttctaagatctaagaatatgcttggtatttttagtgaactttgattttcttttttaagaattttaattaatccccaaatagcaagaaaagtcaatttaaacataaaagttaaaatcatggagtaatagcagatataatctataccctttgtcagtaatgaattactccccgtagcaattttctggggctttttccccatagttttaattatattcactttcttttcttgcctagcagagcttctaacattgtccttcagaaaaactgcagttttttggctctcaaatgtgtgtgtttttcccaggattcaactctacctttcttactttttattttttagtttatattactgaaatactaaaaatctcttataataattataagagatcaaatgtaaactttttataataaggtaaagtttattgtactttactttctccaaagtacaattaacttttggtttactaatgtttttattacccttaaatatgtgttaatccctgtactccatagattattttcctgcaaaatattcaaattgctgtctcttccagcttatcattttcttccaagtagatatcatttaatctataatctaaaatagacaatcatatggaaaatatctgcacagtatagggtttttaaaaaaatatataaggtgtgtaaattatcacaatatgatttattctttcaccaatatttcaccaaatatttttatgaaagacattgagaggtataaatattgttatgcaagagagtgcaagtcatttattattatgacacatcaactcagtaatagaattcaaattagcacccacagaggactcagttgcttttgaaatacaaaagatcagggtttaatgtcaggcttggtttctcatgaaatgtctgtccttgggactgctgaatctcaatttcacattcaatgtcctttccaccacattctataatagcaattagaaaggcatgagctatagcgctggctccaatggagcccatcattctaggctttgttttattgtgttgtgtttttgtttcactttatgtgtaggcaatggaccacatttctatgtttcttctcataaattttataaaggtcaagccaaatgatatatatgattcccccatttctaattgtttcttaaatacatgtttctgaatcctgaccacccatggttctaactgctttaaaaacacaatgttttatgcaatcatgaaaacaaacaagctattttgtgcaatattaattcattctacaaatatttgctgaacatacactaaactgcagatatcatgcacgtaagcactgtgataggaataaaacaagacactgtccctgttttctgtatgaatataaacgaggtgggaggatggatggcacatgagtcttcgaaaaagagacaagcaatccaatgattatgcttcagtatcacatagcagtaagggtgatgaaaaattagaagcattatacttagtcatgccctaaggcaagggtcagcaaactatggcctgtggctcaaatctggctttcttcctgtttctaaaaatgaagttttattggaacaaaactgcacccattgctccctcatttagttatggtctatgactgccctcgtactataattgcagagttcagtagtcgcaacacaggtcatattttccacaacacttgaaatatttattatgtctggctttttagagaaaatatttggccactcctgttctatggaattgtttcacacctcaattttgtgctcaataaaaccgtaactataggtttccttttatttcctagcctgacttgcctttgggttgggcaatgtgactaattctcatcaaatacaatattagtagaagtgacatttttctatccctctcttactctcctaatgatgtagttgaaagatgaaggaaagtcatgaaactcactaattagttttatgagatgttaaagtgaaccttccttttttatatttttattttaagttcaggggtacatgtgcaggtttgttacataggtaaaggtgtgtcatgggggtttgtttaacagattattttatcgcccaggtattaagcctagtactcattagttatttttcctgatcctctccctcctcccaccctccaccatctgataggccccagtgtgtgttgttcccctctatgtgtccatgtgttctcatcatttagttcccagtgatgagtgagaacatgtggtatttgattttctgctcctgcattagttcactcaggataacagcctccagctccatccatgtccctgcaaaggacatgatctcattcttttttatggctgcatagtattccgtggtgtatatataccacattttctttatccagtctatcattggtgagcattgaggttgattccatgtctttcatattgtgaatagtgctgcaatgaacatacgcatgacgtgtctttgtaatagaatgatttatgttcttttgggtatatacgcagtaatgggattactggatcgaatggtatttctgactttaagtctttgaggaatcactgcattctcttccacaatggttgaactaatgtatactcccacctgtagtgtataagtgtggctttttctccacaaccttcccagcatgtgttattttttgactttttaataatagccattctgaattgatttgaaatggtatctcattgtggttttggtttgaattactctaatgatcaatgatgtagcactttttttcatataattgttagctgcatgtatgtcttcttttgagcagcagtgtctgttcacttttctttcttttttttttttttttttttttttttgagacggagtctctatcacccaggctggagtgcagtggcatgatcccagctcaatgcaacctctgcctcctgggttcaagtgattcttgtgcctcagggcctcgagtagctgggattacaggcaagcattaccatgtctggctaatttctgtctttttagtagagacggggttttgccgtgttggtcaggctggtcttgaactcctggcctcaagtgatctgcccacctcatcctcccaaagtgctgggattacaggcgtgaacgaccatacccagcccccaatgcccactttttaatgggggttgatttttttttcttgtaaatgtaagttaatttcttatagatgctggatattagcctttgtcaggtgaatagtttgcaaaaattttctccccttctgtgggttgtctgtttactctgttgacagtttcttttgctgtacagaggctctttagttttactagatttcatttgtcaattttttcttttattccaactgaaggaacacttatacactgttgatgggagtttaaattagttcaaccatgaagacactatggtgattcatcaaacagaaattttgaggatatttctgttcctaaaaacaaaaatataccatttgacccagcaatctaattactgggtatatacccaaaggaatataaatcattctgtcataaagacacatacacacatatgttcactgcagcactattcacaacggcaaagacatggaatcaatctaaatgcccatcagtgatagactggataaagaaaatgtgggatataatatatagcatggaatactatgcagccataaaaaagaattagatcatgtccttttcaggaacatggttggagaccgaggctattatccttagcaaactaacacaagaacagaaaaccaaatattgcatgttctcacttatatgtgggagctaaattataactaatggacacatagagaagaacaacacatactgggcctattggagagtggagggtaggaggaaggagagcatcaggaaaaataactaatgggtactaggcttaatgcctgggtgacaaaataatctgtacaacaaaccccatgatactattttacctatgtaacctgcacatgtactcctgaactcaaaatagaagttacataaaaaatttaaaaaaagaaatgagaacaaagaagctgctttgaggaaactcaacaaaattcaagataacgcagatgaggtattcagaatcctatcagataaatttaacaaagagattgaaattattgaaaagaatcaagcagaaattctggagctgaaaaatgcaactggtatactgaagaatgcattagaatctgttaaaagcagaattgatcaggcagaagaaagaattagtgagcttcaaaacaggctatttgtaaatatatagtcagagaagacaaaagaaaaaagaataaaaaagaatgaatcatggcttcaagatctagaaaatagcttccaaagggcaaatctaacagttattggccttatagaggagggagagaggtgggtggaataaaaagtttactcaaagtgagaacagagaacttcctagacctaaagaaagatctcaatattcaagtataagaaggccatagaataccaaggagatttaatccaaacaagactacctcaagctatttaataacttaactctcaaaattcaaggataaacaaaggattataaatgcagcaagagaaaagaagcaaataacgtacaatgaagctccaatatgcttggcagcagatttctcagtagaaactttacatgccaggaaagagtggcatgacatatttaaagtgctggaggaaaaaatgtttatcctagaatagtatatccagtgaaaatatccttcaaacatgaaggagaaataaagactttcccagacaaacaaaagttgagaaatttcttcaacattagatctttcctacaataaatgctaaagggagttcttcagtgtgaaagaaaatgacgttaatgagcaacaagaaatcatctgaaggtacataactcatgagtaaaaaaaacacagaatagtataacactgtaattgggatgtgtgaactcatattttgaggtgacaaatgaaaaaatagactgataataacaagtatgaaaacttttcaagacatagacagtacaataagacataaatagaaacaacaaaagttaaaaagtagggggacaaagttaatggctacaatatttattagtttttcctttgcttgtttgtttatgtaatcagtgttaagttgccatcagtttaaaataatggattataaaaaattatttgcaagccttaaggtaaattcaaattaaaaatcctacaatagatacataagaaataaaacaagaaattaaaacataccagcagagaaaatcttcactaaaaggaagagagggaggaaggagagaaggaggagatcacacaaaaaactagaaaacaaataacacaatggcaggataagtgcttatcattaatatcaataatattgaataattagactagaatctccagtcaaaagacagagagtagctgaatgggttaaaaaaaaaagacccaacaatctattgcctgcaagaaatacacttcacctataaagatacacatagactgaaaataaggggatggacaaagatattccatgcaaataaaaatcaaaaaagagcagtcgtagctatactgatatgacaaaatagatttcaagaaaaaactataaaaacagacaaaaaatcattacataatgataaagggtgaaaatcaagaagatgatatcataatttcaaatatatacgcacccagatatataaagcaaatattattaagggtaaagagagacataaaccccaatacaatagtagctgaagacttcaacaacccactttcatcattggacagatcattcagacagaaaatcaacaaagaaatgtcagacttaatctgtactataggtcaaatgggcttaataggtatctacagaacatttcaatgaacagttacagaatatacattcttctccttagtacatgaataattctcaaagatagaccatttgttaggtcacgaaacaagtcttaaaaaaactaaaaaataaattgaaattatatcaagtatcttctttatccactataaaataaaactaggaatcaataacaagaggaattttggaaactatacaaacacgtgaaaattaaacaatatgctactgaatgaccaaatgggtcaatgaagaaattaagaggggaatttaaaaatgtcttgaagcaaatggtaatgaaaagacaacatagcaaaacctatgggctacagcaaaagcagaactaacaggaaaatttatagctataagcacctacatcaaaaaagtagaaaaacttcaaataacctaacaatgcatcctaagaacaagaaaggcaagagaaaaccatacccaaagttagaagaaaagaaataataaagatcagagcagaaatagataaaattgaaacaaagaaaataccataaatgctaaataaaataaaaagttggttttttgaaaagataaaattgacaaacctttagccagattaagaaaagagagataagcctcaagtaaataaaatgagagaagaaaaagacaacgttacaactgatgccacagaaattcaaaggatcattagaggctcctaggagcaagcagtagtctcccagcaaagaaaagcccaggatctgatggcttcactgctgaattctaccaaacatttaaagaataactaatacatgccttactcaaactatgccaagaaatggaggaggaggaaatacttctgaactcattctacaaggctggtattaccctgataccaaaaccggacaaagacacatcaaaaacagaaaactacgggccaatattcctgatgcatgttgatgcaaaaattctcaacaaaatactagcaaaccaaattcaacaccacattaaaaaggccattcattatgatgaaggggaatttatcccagggatgcaaggatggttcaacttatgtaaatcaatcagataatacaacataccagcaaaattaaggacaaaaaactacataactgatttaattgatgctgaaaaagaatttgataaaattcaacatcccttcatgataaaaacccactgggtatagaagaaacagacctcgaatagtaaaagccatgtacaacagacccacagtatcatacaaaatgggagaaaactgaaagcctttcctctaagacctggaacttgacaaggacgcccactttcagcactcttattcaccgtcatactggaagtcctggctagtaatcagacaagagaaagaaataaagggcatccaagttgaaaaggaagaatttgaattagcctttcaaaatcttacatattttgaaaaacctaaagattctaccaaaaaactattagaactgataaattcagtaaagttgcagaatacaaaatcaacatacaaaaaccagtagcatttctatatgccaacagtgaataatcagaaaaaatagaacaaagaagtctcatttacaatagctacaaataaaataaaatatctaggaataaacttaaccaaagaagtaaaagagctctacagtgaaaactataaacacggatgaaagacattgaaaatcatataagaaaatgaaaagatattccactttctggattggtagaataaacactgttaaaatatccatactacctaaagcaatctacagattcaatgcaatcattaacaaaatactaatgatattcttcacagaaatggaaaaaacaatcctaaaatgtatatggaaccaaaaaagacccagaagagaataagccatcatgagcaaaaagaataaaactggaggaatcacattgcctgacttcaagttatactaccaagctatagtaaccaaaacagcatggttctggcatagaagcagacaaatagaccaatggaacagaatggacaacccaggaacaaatctatacactgacagtgaattcatttttgacaaaggtgtcaagaacatacacaaggttacataagggaaaagacagggtggtggtggaaaaacaggatatccataagcagaagaacgaaagtagacccctatctcttgccttatacaaaaatcaaatcaaaatggattaaataattaaatctaagacctcaaactacaaaactactaaaagaaagcatcagggaagctctccaggacattggactaggcaaaaatttcttaaggaacacttcacaagcataggcaaccaaagcaaaagcggacaagtgagattatatcaagctaaaaacttctgcacagcaaaggaaacaaccaataaagtgaagagaccacctaaagaatgggagaaaatatttacaagctatccatctgacaagagattaatagccagaatatgtaaggagatcaaaaaactgaaaaggaaaaaaaatctaagaatctgatttaaaatgggcaaaagatcagaatagacatttctcaaaagaagacatacaaatggcgaaccgatatgagaaaaggtgttcaatattactgatcatatgagaaatgcaaattacaactacaaggaaatatcacctcaccccagttaaaatggcttttatccaaaagacaggcaacgacaaatgctggcaaggatgtagagaaaatgaaacccttgtaaactgctggtgggaatgtaaattactacaaccaatgtagagaaaaatggagattttggaggttccttaaataactagaaatagaactaccatatgatcctgcagtcacactgctaggtatattcccaaaagtatatcgaaaacatagctcattctctctcatgtttattgcaggactattcacaatagccaagatttagaagccacctaagtgtctatcaacatatgaatggataaagaaaatgtggtacataaacacaatggcatactattcggctataaaaaagaatgagatcctgtcatttgcaacaacatggatggaactggaagtcattacgttaagtgaaataagccaggcacagaaagacaaacattgcatgttctcatttatttgtaggaactagaaaaattaaaacaattgaactcacagtggtagagagtggagtgatggttaccagatgctaaaaatggtaatttgggtggtggggggagtgggaatagttaatgggctcaaaaatgtggttggaatgaataagatctagtatttgatagcacaatattatgactagagtcagcaataatttattgtaccttttaaaataactaaaaccgtataactgaattatgggtaatacaaagaaaggaaaaatgcttgagttgatgaacaccccatttaccccaaaatgattattacactgcatgcctgtgtcaaaatatctcatatactctacaaatatatatacctactatgtaccccaaaaaactaaaaattaaaataaaaaagagatatctatgtggagaaatggaataacagcaatgggagaaaagaataaagagatggtcataatattaaaatggagataaaaaagaataggtctagaatattcatttaaacatgtttgatttaatataatttttactactcaaatagaattgcactcagccattcagtataaaaaagaaaaagtgttttcacaaattcactgaaattacatattgaatttgccaagctttgatatgtagaatgaattgcacttgtgttcgttgtggcttctccactttaaaacatatccctccactgtggtccagtcctcatatcaccctactttccagaggacttgcttctatacatatttacttagcaggagtcagcaaactacatcttatgtgccaaagccaggcttctgaatatttttgttcagcctgaaagctaagaatggttttcacattttttatcgttttttagaaaaggaaaaataatattagtaacacatgaaaattgtatgaaactcaaacttcactgtttgaaaacaaagttttatggagacatagccatgtccattcattgatgtattgtctatggctgttttcctgctacagtagcagagtgtagtagttgtaacgtagaccttatgaacgaagacttaactattttactctctgatcttttataaaaaaaaaaaattgtgaccctttctataaagtgaataggaaatttcagctgggcacagtggttcacgcctgtaatcccagcactttgggaggccgaggtgggcggatcacgaggtcaggagatcgagaccatcccggctaacacggtgaaaccccgtctctactaaaaatacaaaaaattagccgggtgtggttgcaggctcctgtagtcccagctactcgggaggctgaggcaggagaatggcgtgaacctgggagggggagcttgcagggagccgagatcgggccactgcactccagcctgggcaacagggcaagactccatctcaaacaaacaaacaaaccaacaaacaaaagttaacaggaaatttctctgaggaggtaaagttgaacagacacaggaacgactgtgattgaatcagggaaccagtgcaacataaaaaggtaggaccccttgtttcaagagcaggtacaaaaacttttttctttttcccatgttctctctctagatctgttatggtgttcttttatttgctacttaacgtattgctcccttggtcatggaaacactcacagggtgagggcagattcttacaggaatgcagtggctctgccctgcaactcagtaagtgcatctgaccttgacccttccccacactcatggtctcactactgcatcagcagtttctgggcaggccaggggcacctgggttggaggagcaggtggaaaagaattttactcagtaaagaaagtagaaatagggtggaaagtgggaaaacagttaagtcaagattccaagccccaacacatgttcaattttcccataaaccgccttacaaaaccctgggccaggagcaccagggttgggggagctgctagagtccccagtgtctactgttcccatctttatgtctgtgtgtacccaatgtttaggtcccacttattagtaagaatgtgtggtatttggttttctgtttctgtgttaattcactcaggataacggtctctagctacattcatgctgctgccaaggacatgatttcattcttctttatggctgcatagtattccacagtgtatatgtaccacattttctttatccaatccactactgatgggcacttaggctgattccatgtcttctctatagtgaatagcaccgcaataaacatatgagtgcaggtgttttttggtagaaatatttattttcctttgggtctatatcaacctgggatattttgtgtgatacatatgacgaaaatatttaattctaaatatttttttctcaaaatgatagcctactgtcccaataccattatttatccactgatttgaaatgtcacctttatcatatactaaatttccaaatagagattgggcttgcatttttggactcgactatattcccattgatctatttgtctattcctgtactaacatcacactctcttacttactgtatggcttctatttctagagctcctagtgcgtggatattggatctctttgacccttcctgttttatatactgggagtattctacagttcattgtcctaaagaaccttcattaatttgctaggaaatacttattgaccattatcagctgtgtggtcaggcgctgttgtagcctctggggatacatcaatgaacaaataagataaggcacataattttaggcattttgttttaacttttggtgtgattatgctatttttaattttaaaaacttttcttttttttcaagtattccatttttaaaatagcctgttattaactttataagttcaatcacctctcaaatctttctgaggatactgattagagtctttttctggcattaagtcagttttcttaaaggttccttactttgttcattaagcctggtttctctctttttggttgttaatttttcctcaaccatctggtgtcttggtcaagcactttttatacctagggcactgtccccacattaggagcttcagggggtccttcaccttccttagatacttattaccatctggtgggcaaacaacaaagctgattgctccacataggagatgctaaggttctggttgccctgtccactccctggctttgataaccatgccctgttgctcaggcttgagattcttcgcagaggtctaatgaggatgtcaaatccactcattgttccagtgacatcttcccctcttccaccagtgttggatggtgggctttttcctcttgttttgtctaaatctagcaatatttgattttatcttttagaatttcgcaaatgcctcaggtagtaactctccctgtttttcatcactgctatgaatttattgttaattttgtatttatttttaccattttgattgcaagtaaggaggaggaaaatgtaaacacttgcgatccactcagctttatcagttagaattctcatatttctctgtcttgatcactttgaagactgtatataagagatttgaggaagtctggacaactcgaagaaagtaagtatcattgccatttcatcacagatgtcatgcaaatggaaaattattatattttcttgatttttcaataaatggaaaacaattttaagtgaagtacaattttttggttgttatgaatatgatgttaatgtgatcaagacttgctctaaagatgtagaactccttatcttcaggtaggcaaatgcaattcttctgctttatagattatggccaaacatagacaaaaaatatatgatcaccacaagggagttaaagaagtcgtgagtgagtattgagtatttaagagacgtggacattcttctaggcacttgaaatttgttgtctcattgaagcctataatgttagtatcaaaagtagctattactctttccattttatagacttgagattcacagataatctcagttaagtgggagagctgaaattaaagttaagtgggagagatgaaattaaaattaagcgggagagatgaaattaaaacacaaatctagtgaatttcaaattgattgcattttccccgaaagacaccacactataggtaaagcaaagagaagcaaacatatttacaagtaaagccaagagcctaataactcttgagtttctcatctttatatcaacgcacaattttcctactcttcagtctattggtagcattgatttttttaaaaatctacattgtttcaaaagctgttgaaataaaacgcaagtgggtggaaaatgggaataaatagtatctaattctgctatgcattaaactcttacagtcactacattttttataagagaaaggcagaaaatttttaaaaatctttatatctcctgactttagctcttcatttcatttttatatagaggtatctgactatgaaataatatgcatactcatcttctatttaaaaagacaaattataaaacagactgtagggactctgtactgcttctcagacactgcaatcccacataggagcaaggtcagatttactgatacaggcaactgtccaaagcagctcttctcctgctagctgttgatgttctcttcctctctgccagctccataacaagggccctcacccggtgcaccaccctcgcccacacacacaccctgaccgaggccctgagagttccaggttcctgcacctgcctttcctgcccagggctttttgagaacagacagttgctctcaagcccagggctttctgagagcagacagttgctcttgagcccttctctgaggtcctctgaacacccctactccaccatcaatcagagcagttatactttttttttttgcttttacctattaggtttctgttaggttgaaacatatgaaactgctgatattcaaccgtattacctgcaaaaatagcaatttcatataactcagcctacataaacttttcttttaacagagttctctggctaaataatttgaaaaccatttctctaggccttaagtgagcctgacattttgctggccccagtaaaattgaactctttcccttcttagacatcactagtaagagtataaagacacatgcacatgtatgtttattgcagcactattcacaatagcaaagacttggaaccaacccaaatgtccatcaataatagactggataaagaaaatgtggcacagatacaccatggaatactatgcagccataaaaaggatgagttcatgtcctttgcagggacatggatgaagctggaaaccatcattctcagcaaactaacacaggaacagaaaaccaaacaccacatgttctcactcataaatgggagttgaacaattagaacacgtggacacagggagggaaacatcacacactggggcctgtccagggggtgaggggttaggggaaggatagcattaggagaaatacctaacgtaaatgatgtgttgatgggtgcaacaaaccaccatagcacatgtatacctatgtaacaaacctgcgcgttctgcacatgtattccagagagtataaatgggtatatgcccttttcagggcaacttgtcaaaatagattttttaaaagtgttaagtctatccctagtatttaacatacataagcatgagtgtggagtttgttagatggaaaatttgtaatatatgtttcttcgtatgagttagtttcttcatacaatgtattcaaatcttcattggaaagactgtatacacacatgagaggataataaaagttctagtttttattctagttttatttaataaaggtcaaaagtagttttggactcaatgtagatattaaagacctgaaaagcattttgacctccaaaccatggagtttgtcctcatagaagctttcccagcatgaaaatagtcacaactattttgcaaaaaatactttttgacttaggtattgcaaatacttatatattaatattttatagatgttcatgtcaacttcaaatgcatccagaatttaaaataagtaaaaccagctttattttccacacttaagttctttttttaaagcaacaatttcaagtgatttgtttcatcttaggaacagcaggaaataattatgcaatggattatagaagatatattctgaacagctaaaataggaagcacatatcactgtgtgggtgaaagaaagacatttttacaaataaaggtgcacactgctttttaaatagcttaattttttaattaaattttttattttcaataattgtagattcatatgccattgtgagaaatcatagagtgcactcatgtttctttttcctagattccctcagtgggcacatctcacaaaattatagtgcaacatcgtaaaaaggacaagaaacagagcaattccatcaccacgaggatccctcccattgcccttttttttgagagggagtctcgctctgccgcccaggctggagtgtagtggtgagatctcggctcacggcaagctccgcctcccaggttcacgccattttcctgcctcagcctcctaagtagctgggactacaggcgcccgccaccacgcccggctaattttttgtatttttagtagagacggggtttcactgtgttagccaggatggtctcaatctcctgacctcgtgatccacccaccttggcctcctaaagtgctggaattacaggcgtgaaccaccgcgccaggccccattgcccttttatagctacactcacttctctcctgcccccacctccaccttaactcctggtaactaccgatctgttatccagttctacaattttgtcacattaataatgctatattaataggatcacacagtatgtaaccttttaggactggcttttctcactcagcatacttttctgcagattcatccaagctgttgtgtgtatcaatagcttgctccattttattgctggatagtattcaatgacatggatgtttaaccattcacccaatgaaggacatctgggttgtttccagtttttagctgttatgaataatgctgctataaatatttgtgtacagatttttcagtgaacatgttttcatttatctgggataaattcccagaagtacaaatgctggttggtatggcagttcaatgtttaatgttttaagaaactgccaaactgttttccaaaattgctgtacaattttacatttccaccagcaatctatgagcttctctgtatccttgccagcatttagtgttgtcacaattttttattttagcccttctgataggtgtgtagtgatatctcattgtggttttactttgcgtctcccttgtggataatgatgttgaatatcttttcttgtgcttatttgctgccatctacatatcctctgcagtaaaacgtctcttcatgtcttctgcccattttctaattggattatttttatactattgagttttgagagtgctttataagttctagatattattctttgttagatatgtgatttataaatattttctccagtatgtaccttgtcttctcatcttcttaatagggtttttcacagagcaaaagtttttaactttaatgaagtacatttttttttaaccagaggtgctagtcacaccttattctttgatagagcataaacagaggtggggagggagacagtgcaaagggagaagggcaggctcttgagagcgaggttactggcatgcagtcaggccccctctgatttggggactatcacttcttaaacacgtgctctgtggccgttgccatgccaagctcatttatatttgggaggaaggagaggatcaggacaatttatttttttatggattatgtctttggtatcaagtataagaactctttgtctaactctagatcccagaaatttttttcctatttttttctaaaagttttatagttctatattttaagtcaattatccattttgaattaatttttacataagccatatgacttaggtcaagtttcaacttgtggcctgtgtatgtccaactgctccagcaccaggctatcttccctccactgaactgcttttgtacctttgtcaaatagcagtcaggtttatgtgtatgggtatatttctgggttctctcttctgtcctattgatctaagtgtctatcccttcactgataatactacattgtcttaagtactgtagctataaaataaatcttgaaactgggtagactgattcctcccacttttttcttctctttcgatttttttttagttatcctagttactttacgtatctatgcaaatattagaataatcttatatttacaaaaaagtgttgctgtgactttgataggaattatgttaaatctaaatatcaatttggaacaatttacatctttgctacactgagtcttctaatccataaacaggtatgtctttccacttctttgaacattttttttcatcagtgttttgtagttttcagtatacaagacctgtacatgttaaagaggagttcaccgaggctcataatcaaactatcaaaaattaaagacgaagaaaaaattctgaaagcagcaagaagtaagaaacatatcacatacaaagaagtccaatgtaactatcagtggatttatcaggaaaaaccctgcaggctaggaaaggggtaggatgatatcttcaaactgctaaatgaaaacaaattgccaaccaagaatacttaaatcagttaagctgtccttcagaaatgagagagaaatagtaactttcccaaacaaaagctaagggagttcattatcactgggcctgtttcacagaaattactaaagggagttctttaagctgtatcaaaaggccactaattaataacataaaacatgcaaaagcacaacactcaatggtataagcattacagaatcacattcagaatactctggacaaaaatgttggtatgcaaagcaattttatctctagtacaatggttaatagacatctattaaaacaactataaataaaataatcaggggatacaaattacaaaatgatgtaaattttgacatccaaaacataaaatgagggatttggataaaagtgttagatttatatctaattattattttttctttttgtatttgtgattataaatgaccttgtatttttaatttctgtgtatatatgttcataactagttcacagaaatacaatttttttatgtgtatcttgcatcccgtgaccttgttgagctcacttattagtcacaggagtgctgtttttgttttgttttgttttgttttttagcttgcttcggatttctacgaagacaatcatgtcatctgcaaataggaagtttcagttttcctttccaaatctgtatgccttttatttttttgtttttcttcttggcacaggttagagcttccagcactatgttgagtgacagtggtgagcacagtggacatccttgctttgttcctaatcttagaaagaaagtcttcatgtttttaccattaagtataatgttagctgtagattttttatagatgctcttcatcaagttgagaaaattcccctcaatttctattcttttaagaggtcttaaaaaacaaaacaacatgaatgggtgttgaattttgttgaatgctttctgtgtatcaattaatatcattatgtggattttcttctttattgatttcaaatattgaatgagttatgcatccctaaaataaacctcactttgtaattgtatataattttaaaaatacatttctgaatactatttgctaatattttgttaggaattttttgtctatattcatgaggaatattgctctggggtgtgggtgtatgtggaattgggaatactaggtcataaaatgaattagaaaacattcccccattttcttttttcaagacaagattgtttagagttagtgttaattcttctttaaatgttgttataattctccaacaaaacaatgtgagcttggagatttattttttgaaagcttttttgattatgaattccatttcattaatagttgtagggctattcacattatgtattacatattgggtaaattgtggtagtttgttttaataattgatccattttagctaagttgtcaaatttatgtatgtagaatagtttgtaatattcctttattatccttttgatgtcttcagggtctgtagtgacatccctattttattcctgatataggtaatttgtgtctttcttttttctctcagtttcactttaagaacagtaggaaataacaatataatgatttacagaagatatgttcctagcagccaaaatattaataaaagcttatattgctgtatacgtgaaagaaaatttttacaaataagagtgggcattgcttttggtttttaacttctcaaaggtcattctgctttctaattcttgtttttagagatagggtctcactctatcccccaggctagagtccagtggtaaaatcatatcttactgcagcctcaatctcctgggctcaagcgatcctcccaccttagccccctgagtagttagcaatacaggcacacaccaccgtgtccaactaattttttaaaactctttgtagatatatggtctggctatgttgccaggttggtctcaaattcctggcctcaagtgatgttcctgtcttgacctcccaaaatgctgggatttcaggcatgagccagcacacccagcctgctttctaattcttaagtcatctctttactattatagtaatagtgcccatgaaatacattctgtttcaggtatcctacctttttttcatctaaatcctacaaaaactccacagatgggcagacagggaaactgagtgtcaaagatactcagtaactattggacagctttagaatccagctctctcaacacttaaaagccatgaatacactttccattacatcattctgtctttttgctataattacccaaaatgtcttcctatacaataaaaataacagaacttttttagcttaatgatagtttaaaagaatattttccccagagtatctgtaaaagcatttaccacgagggttatcacaaagtaataaatatgttagtaggtagaataaagttaaggtttaaaccagaaagatgtgacaatataagtacttctgtgaataaatttaagatggtgtgaagttttaagaataagcacatagcacttcccctggagtaaaatataatcagggtcataaaaatttgtgtcataatatgatagcaataagttttaaagtgaagataagtattacaattaattttagctaacaagttcaactccttttctgctatttttctaaaacagttataaaaatgcccattaataaaagtttgtctttttttcctgactcattcctggcaaaggaatattcaaaaggttgatatgaaggggtataagtatataaagcaagtgttaaaaaatacataaactcagtaataagcttctaaataatcaagaattgttatgatttgtatgtaaatttcatttggatttccctcaaggaaacaaaatcattaagttctgaaatagtctctaattctaaaactcctttcttcatcttcatatcaatgaaaaaattggtatcctcaattaaaaagtacctttatgtttctaactaattcctatgggttaaacttattaacacatatttgggagacaaaataggatttgcagcaaagtagaattggattcagatcctaatgtcggtatttacagtttagtatttgcattcacaaaatgaggattatataagcctccccacagaattattgtctggattaattgagataatgtaaatgaaagactagaataaggcctaaattagtaaaggattgataagtattcatcttcttctcccactgtaatattttagtataagtaggatctaactgaaagaagacattgatgagttaaatcataaggcagccctcctaataaatggcagaatcaccaaattacatgaacagtccagcagaatctccctgacacaatttacagaggtgaaggttgaaggaaaagaggaaatcaataggttcggaagaaaatacagcacacagacttattttatcagtgtttaagagagctgccctggaaattgcagtaagagctctaagtagaaaccttccgggggcgtctctgatgggaaataagtggcagagaccctggtagaacctctctaaatagcccaccatctctgatttggaggagtgagggctcatggcaatgagggaccacaaagaagggggaaaaagaagagaagatacactccaattaatcacaataagcctttttagaaagcatggcattaggaggttaaagagcccctgtggtgacttgtttacaggagcagaaagttaagaggctgttaggagcttgaagaggaaacatcagacttcagcttctgagaaagaagttagtcattagacatattttgctttagaaacaaacccaagtgatatagtttgaatatatgtccccatcaaatctcacactgaactgtaatcctcagtgttggaggtggggcttggtgggaggtgactgggtcaatggggcaaatccttcatgtcttggtgctgtcctcgtggcaatgttttcacaagatctggttgtttaagtgtgtggcacctccccaccaaccccactctctctcttgctcctgcttttgccatgtgatgtgcctgcttgcacttcacaacttctgccatgagtaaatgctcccttaggcctccccagaagccaagtagacggtggagccatgcttgcacagcctgcagaaccgtgagccaattaaatctgttttctttataaattacccagcaaagcaggcatttctttagagcaatgcaagaatgtcctaacacaccaagcaaaacataaagatggatgttaatgtgccctggtgcaatggcatcaccaaacacagataagacagcacaaaataattcttcttgatgggactgctcattcatgactctgtcatcttctccacttaccagatttaagagaaataaccagcactatccaatattaactaaaagatagatgccattctttccctcaagcacctcatattttagtgagaaagctatgaaagaggaaggtgaaaagtcctatgaagaaatagaacttcctatgaagacatataaccagggatctaacctaatttggagtgtaaagagaagcttctttaaggaagtaatctttcagctgccacctgaaggagatgtagaaattagctaagtgaaagcagtgtgagcgggttaaaatgaagtgtccaagtcagaaggaacatgaaatgccgtaatcctgatgtttacagcaggaaaagatacagacagcacatgtaaggaactaaaaggtggttgatgtgttcgggatacaaaaaggaagaagaagagagagaatgggcacatctttccagaagtttgtgaaatcgaataaaatttgcatagctatgggagatactattctatgatggcattgacttgagtacattaaaatgctgatggaaatgaggtggtaaaaagagatatattaaagagataagaacaaaaaggaattgagagtaaaaatttcctacaaaggaggtaagggtggaatttagagaatgtgtgaaaagtttgatgtttagagaggcagaggaatgccttcagtttaataggatggagaaagaaatgaagaggttcagaaaggttttaaacattttttggcaaagtattgaggtaattccttgttgatgacttccagtttctctggaaagtgaggattaaattatctgagtagactaggaggaaaatcaggtatctgtgaagagtaaaattcaaaagtcattaggaaagttggcatgcaagctaactggagaaatttaggtctgctgagtagtgttaagggcccagaagagattgagaactatgaatttataacattaaaataagattatgaaaaaattcaacatcactgatcattagagaaatgcaaatcaaaaccacaatgagatatcacctcacaccagtcagaatgactaatattacaaactcaaaaaataacagatgttggcgaggttgtggagaaaaaggaacactcatacactgttggtgggagtgtaaattagttccattattgtggaagagagtgtggcaattcctcaaagacctaaaaacagaaatacctttcaacccagcaatcgcattactgggtatgtacccaaaagaatataaatctttctatcataaagacacatgcacttgcacgttcactgcagcactattcaccataacaaagacatgggatcaacataaatgcctgtcattggtagactggatttaaaaagtgtggtacatatacaccatggaatattatgcaacagaaaaaaaaaggaatgagatcatgtcctttgcaggaacatggatggagctggaggtcattatccttagcaaactaatgcaggaacagaaaaccaaacaccacatgttctcacttataagtgggagctaaatggtgagaacatgtgaacacatagaagagaataacacacactgggacctattggagggtggagggtgggaggagggagaggatcaggaaaaatagctaatgggtactaggcttaacctgggtgatgaaataatctgtataacccccccaccccgacacaagtttacctatataacaaacctgcacatgtacctctgaacttgagggttaaattttttaaaaagattatgaattgattaacttctcgacttaggcttttttctattttacctgaaaataaatgaaacaatttattagtctctcactatttactcttgcacatatacatatatatccatatataaatgagttaatgcttttgcatttatttcagtgtaatataataagtagggaaatacgatgtgtgattattatatagttattatggattatgtactttatcaatataaaaatcctatttattcctatgctttttatctcagtggagtccaaggattaggccatgaaggattgaaagattcagagcaatgttccaggcagaagcgtatgttttgaaagagcatgctgcttttgaggaagtaaaataaatctaggtttggaatatagactagaagagatcaagaagtaagaattaactccagaaataaacagaaacctggtcatacagtttgatggctttaagttgaccaagcaatggtggtcaaacctgtgcttagctaggcttaaaagctatgaagtaaatagacaggtttgaaaaaaatagactatcactttgagaaacaatctggattttatgtgtactattttatttaattttttcctcctgtacaggtagcagaaacacacacacacacacacacacacatacacacacacacccataaggaaaattttaacttgtctatctatctatctgtcatctatctgtctgtctgtctgtctgtctagttaaagcaaactaaatatggcctgagaaggactccatacttccatatttgaatccttgtggatgaaccataacctagcttaacaggcagacaagatgaaaacctaacttaggagtatgtgcctgtaacaatagctgagtcttggccaatcacagcagccatacctcaaccactcatagactgctaagtgttcaaacagggttcaattaaggcaaaagccaacctgtaaccagccgtttctgaacctcacttctaagttcttttctgtacctcactttcctttttatgtctataaattagttctgaccacgaggcacccctggagtctctgaatctgctgtgattctgggggctgcccggttcacaagtcattcattgctcaattaaattcctttcaatttaattcggctaaagtttttcttttaacaatatataaacacacacccacagttgtacatattacaaatttgcaaataatctgtgtatatttatattcagtttattttgtagttaacagttaacatttttatagttaccatataattaagttattcatatgattaaattagctttcaaataatttttaatatttttaatattctatcttccattcaaacaaaaatttttattctaattcttttctgttataaatagtagtacaatgaattattttacagaattgtttcctctttctgggcatttcattggtacagacaagaaagtactagacgaaaagtagtatgtttttcaagattcttgattcacattaccaagaaaatgtatagaaacatttccaccattgttctacaagactatcagtctgtgcctgcatcaccatgaatttaccatgcatttgctaagcacaggatatatttttgtttttaaaaagttttaactacttcttaggttatgttataactttattgtgcatttccttgatattcagcgccattaatcatttttccttttatttattattattctttttctttcttaaattgggtatttatattgtttgtccattttcctctgtggatgtgttagtcttctttgtggccttctaagagctctttgcatattaaaattttaacagtttcactgtttatatttatctctatagcattagttacttgttttctattttaataaagtttttttgatgcaaggcaacttaatttctatgaagtcaaggctatttatcttttcctttggtattactttcacaacttttgtgttaagtaaatgtttgtatctgtaagattatgttcgaaatattgacagtgtgtgtctctatcttttcatacattttgttagttaatagagaaatgactgctgagctaatcatttgtaactgttgtgacagaagaaagtgaagtgtaaagatgagaagataagaaaatgtgtctctcagagttgttattaatcaccgtcaatatttcattagagtgcattgcctaatgtctgtttatgtaatttaacttttttgaaatagtctttttcctcacatattttgactaacttaatgacccacttaatttattatttcatgtataattgcaattattatgtagatatccgtttgtgttgatatctctgtttttttaaatggaaattaatagaagatataaaatacttttggatctttctgatattcaaaaaatatttttgagaaaaattatcttaaatagtaatatgatttggtacttgactcaattcaatttagcatttattgcttgctgtctcatacaactgttctaagaattcatgtcaaattatatcagttattcctgtgtccatttagcatatatttattgtcaagttcttggctaaagcaagaatccaagaagagaaatttcacagactagtaagagattatttgcaatttctgctttttaaatagtaatgtaattaatatactttccagaaaatttttccatcttctttgatgcataagtagactcttaaaatacacatataaaattatgtgaaagtacacataattctaagaaagcatagcagaagggctagagacccttatatttaactatctacattatatctagagggtatctaaaacttatacaaaccaaacagacatttgatccttgctccccagttccagcaacatcaaaacaaacacaatgaaaatcactgatttttgcctagatctcaccatttcagtaaatggcatcgtgatttttcacagtgactcaagccataaatctggacatgcttgattcgtaacctgtatctcctaaattcaactctatggtaaatattattcattctactttgaaaacatgttctaaaaccactcatttccctatacttcggatttacccaccaatccaaataactgtacatgttctcttggacagctacaaaacgtcctaattgtttcccctatttttccctccataaggtattctctagccagagtgatcttttaaaaatgtagatcaaatcacatcacattcttgcttaacacccttcagtggcttctaattgcacttggagtaaaatctacacttcttaccatgacctcattggctctctgtcttctctggtttcatctcacagcactttgccctcacactgagctccagtcatgcatgccttctgtctgttcctctgctccaagttcatgtcttcatctgggtctttgtattgctatttcatttccctgcctggaacattcttcctctgactcttttcatggctaactgtttctcctcattcatgttccagctcgaataccacctcttcagagaggccttctctgattccaagtagtgactcctcctccaaatactgtttgactctgtgtagttaatttacagccctgatcacaatctgaagttatattctctatttattgttcacttgatcattgaatatttacctcctcttgaatagaggctccttgaggacagtgaactcttttgtcttgctcactgttattacctgtactatgatgaagcctggtaaatagagcacacttagcaaatatgagtaaaacggatgaatgaataagggcatctcagtgaagatggggtgagaaagggttatgctagctggtgcttggatcctacctaaaagaaagaacagaagttaaccaggtagagaaaaagagggaaatgcattctagactgtatcggaaagggtgcaagaacaagtctcctttggagagttgcaggaatttgggatgattgcatgttggcattgctggtgataaacaggagcccagtgcaagaacatttatggacttttatgccttatcgagtaagaagtttagaggttgtcatgaaggtaggaaatcctaaaggatgttataaaagtgaataacataatcatgttgacaatgtaataagatcactctcctcacatgggaaggagtctggcattgggtgagtagggtatccttgtagggtatcctcctactggcagtgtgaggaggtgtccacatgtggagggcagccagggtagagtcaaggcactgtaaaggtgagaagggtatccatcaggggccaaccaggcatgaggaatcagagcatacacaaagtaaggagcagggtggatgtgtgtgtgccatgccctgagcaggaggtgtccatgtggagctttactggcatgcggtatcagagcccaagtgggatgaggccagtgtccacatttggagatgaccctaaatgagaatcaggacctgatataataacaaaatacactatgaataaaggaagctaggtttctgactgtcagagaatagaactacaaatataaaaatgaattatgtgttgtttagatcgaaatcacattacttctgtaaactcatggctttcaatatatgttgagatggatggacacagaaatatagatgttcctgtgcatgtgtatatttgtgtatacatacccagacccacgtgcatacgtatatgtacgtactatgcttatatacaaatattctctagccctgcccactgagagagtctgagaacagtgacatcccagtagcaattaatatacgtagtgcctaaatcttggcattaaactaccattttatactaagaggaagtaaagcttcttagagaaatagctgattccacatctaggactggaaaatcatatatgagataagcctagaaatcccgatgttccagaaagtaaggaatgctcaaagagtgatggagataagtcaaaaggacacaggaggactccctttggcaaaactctaaataattcaaatatcaaaaccaataataataataatggagtataactaactcaataaaataggaaacatgggtctctgcaagtataaacaaatacacaagtaaattgaacgttttgtgaggaatgggatattcacatagttttaaagtacctccccacaaatgtatacacatttcagaagagaaacaaacaaacaaacaaacaaacaaacgaagagaaagagtaaccttacaatggagaagtctgaaagaaaccaccttaatcaagtgaccaaggtgaacatcatttgaaaaatcattatcacaaatcaaaatcatgcaccagctgataggatgcaataagaaaaacagagtcatctctgggtttttctgacaaagatacataccctgaatctaattataaggaaatatcagacaatccaaattgaggaacattacacaaaatagctgacctgttatattcaaatttgtgattgcttttaaagtcaagaaaagactgaagaattattccagatcaaatgagattgaacaggaatgaaaactagaagaatgtatgattctaaactagatacttttaccataaaacatattattaggacaattggtgaagtttgaatggagtcttaaggttaaatggtagtaatatatcacaattcattatctgattttgatgtttgtgttctggttatagataaatatccttgtttgtaagaaataacatggggccgggcgcggtggctcacgcctgtaatcccagcactctgggaggccaaggcgggtggatcacgaggtcaggagattgagaccatcctggctaacacggtgaaaccctgtctctactaaaaaatacaaaaaattagccgggcgtggtggcaggcgcctgtggtcccagctactcgggcagctgaggcaggagaatgacgtgaacccgggaggcgaagcttgcagtgagccaagatcgtgtcactgcactccagcctgggcgacagagcaagactccgtctcaaaaaaaataaaaaataaaaataaaaaataacacaccagtgctaatgaggcattagaacagcaacttactcacaaatagttccaggaaaaaaaaaaaaagatctttagaaaaaaaagatctttgcattgtgtttccaacttctctgcaattttgtgattgtttcaaaatataaaataataatcattttaaaatccatgaagatcactctgtgataaatatagaagataaattagaagtagaagagatgacatcaaggaagccatgatgggagctatttcagtaatcaagtcaaaagaattaagacaggtacagtgggagtagaagagaaaagcttagaaagataggaaacagaagtgacatgctttggtggctaatttgatacagaaagagaagtagaggaggagtctaggtggtacagttaattgatataaggaaggaagagcagatttttggagaaagatgaagattttgatgtctggcaagtaagtgtagtgagtcttatcttccaaacactgtacgttacttgaccaaatgaaatacaagttattggcttattgttaggatgaacttctattctctggcttcatgtttccacaagaagggaataccattagagtaacatcctccacctattctccgactccttattaatttatcccctaaggaattagagttactgagctgtaaaacgacattggggaaggaactaagcatgcttattattgcctcttccatgtttctcctcttcagagacataataaatatgttctctgctcttctgtagtaaaatcaccttgtaggttggctagctgtgccagtgactgggttaggatgtgtgtctaatccaagagtgaagttacagcaagcatattcagtaacatatctagaatcacattgtccaatcagttctcatgatgataataaaaagtatggcatttggtttcaatttgtctaactcttggattccatacctcagttggttctgaatctgggagagaaagcaagcagtgtggttaatttgtttcctaaattcaaaacaattataaaactctgtttattcctcccagtgtctaatatagtgcttaatactcacttattgaattgagttcaattaatgtaaaataaaatgatgctaaaataatactgtcttaaaggcgaaaatataggtccttctaattatttgtttttccattttaggcatttagcaccattgatttaaaacttgttcttcaacatgacataatctaaagatacttatttttcctttcctcacagataaaacagaaatcataatggtcttatccatctcacgtggtttctcaaaggattaaagtagacagtgtgtagataccactctgtaacatcataaataaatggcatatttattgctgagtttgggtgttccctttctcaacagtgtgaatttgtgcaagatgagtggaaaatcaaaccagaatggaattgttagggtcagctataaagaggcctatgaaatgccctagatcatgtttttcaaattaagttttgtgcatcactagttgtgaaatatattaatgggtttacatgggtggtagcgaaagaaggctctgaaaaatcattcagtgaagaaattatttaaccctgtatttccccaatatatttgacaatggaaactttttatataagaacatcacttacagaatgagtaatccatagatattaggacattctgactaagaggaaggtggcagaatatctggttgggacttcctaattattagaatgccctaagtaaatcagcacagcacttaagtaaaaagattctaaatcccttgcttatcctattcttctccctggactatgtatctgcctgctacgatatggatatggcttagtttgtccccaccaaaattcagattgaaatttgattcccaatgtggccgtgttggcaggtggggcctagtagagggtatttgggtcaagaggacagatctctcatgaatggcttggttctgttctagcaatactgacagttccaagtctgccaagactggattaattctcatgggtatggagtaattcccataagaggtatttgttataaagccagacaccactggagttttgcctcttcacatgttttcactttccctttgaccttctgccatgttgtgatgtatcaccagcagctgggcagatgtcaacacgatgcttcttgtacttcccagcctgcagaagtgtgagttaaataagcctcttttcttagttcattttatgttccatataatggaactcccaacctcaggtgttccattatagcgacacaaagtgaactaagacttcacctatctaatgcctattcaaacataaaggtcactttgagcatttcctctctggaatagtcttcactgccctttccccaactattcttaattaattcaggtggtacttattgacagccagttgtgaaccaggtactgttctcagtgccgaaattgagcactttataaaacaaggaaggaaggagggaggaaaagagagggatggaaggaaggaaggtagaaagaaataaaggaaagaagttcttattctcatggcatatccattccaggtgggaagaaagacactgaacaaatcaacgcataatgttagttcgggagtgaaaattgttataaaggaaaatagcataacagagacagagaataaagtggtagctactttatattcaatggtcaaaaagggcatctctcataaggtagtatttgaataatgacctgaaggaaggatgataattagcagtgttaagtctctgggagaagggctttccagacaattcaatgataagtacaaagaacctaaggcaggagctgtttggctaatctaaggtactgttgggaagatgacatggctagtgtaaattaaacaacgtggagaacggtaggagatgggttaagaggttttagagagtcagattatattggatgtcatgcttctttactttcagtgagatgggaagacattggaaggttgagcaggtgaataacgtgatctgatttatatatgtggccaagttacaaaaggacaagagcacaataatcaatgccagtaacaagatatgaagctttttcaaaggtctaggccagagatgttagtggctcatacaatagtgacagatgacagatggtaagattcaagatatatttttaaagaaaagttagaggactgatttttgaactttttggtctcaagatcccttgatgcccttaaaaattaataacactgaagattttttgttcatgagagtcatatctgttaatatttatataaaaactaaaaataaaaattctttaagcataatacacaagtgcgcattccattagccatcagaggtatgatgatgtcatcacttaccatatagcttctggaaatctccatttagaactcatgtacaaataaaagcagaacaaggcaaaatgtctttgtattattatggaaatatttttgacctcacagacctttgaaaaggttttgaagcctgctaagaggtcctgaaccacacattgagaactgctggcctagaggatttttttgatggaatggatctgaggtgtgagagaaagaaagaaatcaaggatggggtcaagtttttaagcctgagctgctattaactgaaatgcaaactgcagtgctatataagttaagtttaagacatcccattgagatttagggtagcctgctggacatgagcctggagttcagggaagtgggcaggcctggagatacaaatttaggaataatcagcacataaacagcattgaaagctctggaactggatgagaacacatggggagtgaaagtagactgagaataggtctgaggatgatccttggggcattggatcaatgaactccatcagtgaaattccaaaagttctctatttagagcacagtctcctttggttggttaaaagttattttaggatagaatccatattttagtcattttcatactcaaatcaccgcttaagatgcccagcatatggtaggcactcaactgtgtttattgaataaataaataaattaattaatgatgtcctttgtggtactttcacagctaaattccagaattttagaacaggcaagattaggaagttggaatgatcaggttcagattcatacagtaggtatactattcattgtatagtcaaacagatttccttgaacttagaggaagatgtaattgactgcaccctgtgctgtcaataataagtgacctaaagggaaggatagactatatttcaaattctagtctgccatttaagatatttaaagcaataatgccaactctactttctgatcattttattttgcaaggaaattttttcccagaatattttttctttctatgcattcttttatttaattacacaataaatttaaccagctttacagaccaatacatatatatctacaaaggatgtatttcatttttgatgaacatactatggcttatttaacaagttatccttactaataggcattaaggtttccaataaatatttcaataatgaacatccttgaacatatttttatttatttattaccattttaataaccacatttattttcattattcttatagcacatctattcttagccactcatgtgatttgaaaatacttttatattaaatgtctatttaatcaatatttcctcatctttataatgattcatttgcatctcttccaaaacttcaagttaatgtctaaactcaattttcttttgtttctcttcttctatttttattttaggtgccaggggtacatgtgcatctatgctttctcattcaggctgtctagacatgctctaggggaaaaagctgagccaaacaatgacacccactgagaattttatgcatgtgggagaaaaacccctgaataacacaaaaggaaaacacaatattaatacagtcttgctattactggcaatgtgggcacaaagtataaaaaattacatttcatgtttaggaaaaaagatgaaaaaatttttttacttgtagaaagtgccaaataacaaaaattctccatattcctgtaggataaactcacctggaatttcatcaaatgaatagaaatgaggatgaataatattccactggcatataattggcatgaccactatatggattgaaggtgattttaatcatcaatggaagatacaatgtacagtggttgttttctggattccggcttttccctcccctgtattaggtcagcctgaccctgtactgtgccatttatcctcactgactcctcccatatcccaaattccaggagtttatacttcctgtggctcacttaagcagaggcatctaaagaatgagatgcttgaaggtgagtatcaccccatatgtagccaacatcttcttaagtaggttccaatgatttagggaactttaaaaggttcccaaatacattttctaaaatccacagttgccatgatcagagctacttggggatgacacagagagttagaacattacttctcagaggtcttatttcaattgtaggcaaacatgatctaatcaccattataataacaagttgggccactacagggctttacaatgtacacagcaccatggcaccttttatctggtttgagtctgactacacccctgagaagcaggcaaggcaaataccattctcactttgctgaaaaactgagggtgagaagggtaatacagagtgcatgtgacagaagaaaggttggaactaaattccttttaaagaggcacctacaagcaaaattttgcacataattccaggaattgtgtagaccacccatagcctatccaagaacaccaggttaaaaatatttgccctcagacagactgatttaattggtcaggggtggaactcaggtatttttttaaaaagcttcccaggaaattcatatttgtccaaaactacttcaaaaattcatatttgtcaacgttgactgttgggtcctgttgccttctttctcattttttttcctttccaaatcgctctttgttttacttaatattattttctattacgtctatctttctgtttttagccttctcttctcactcagcttttgttgcaagtctggaaattactgaatacagtcttctttggctctttccttcagactacatactactgccatctatgtttctgttcttcctcctttttcaaaactattattctctcctgaagcttcacccttctagaatatcagtattccacctcgattattttctacctaatgagctaattagcattaatggaaaaactactgaagttaggaaatcagagatcttccagtaagtcagtggcctcaggcccaatcagtaaaataaggaaaaatatacctacctgatagaatttttgtgagaaacaaatgaaacacatactcaatcatgggaataaaatactcaatactcaataataaaaatatttttaaagactatctccttgaagttctttttattccttatctattttttgctgcaacccaatacaatattctgtactctttccaagttatatgcctctgttttttacatacccactctcatttctaattttaaaatttagcatatgtattctataaccccacagtgcccagaaaaatgttattctggatttggcaagaattttttgtaaccccagttctaaactgttaataatggcagggagaggtgctatggcttattattaaactgctttattgttagctcattaatcatacacaggtccagaagaatattcaaaatgtttctttcaggttgagtaggtacctgatctaaacatggtccattatgagtaggtgttcagaaatgactcatctttcctccaatcatctcctttagtgtcttgagagctctgagcctttgacctttctccttattttctttacctctacagcctctttgcttctttttgctatggtccctccttagctgcaaaagaatgcagcctggtgttatttcattctattgaattccatttaggatgaggttttgggttagtggtgaggtttggatggtactaggaacatctaaagccaattggaatgtcttttccggctgctattaacaaataccaaaaagttatggggtctctcccagttctggaggttgagaagtccaagatcaggtttccaccttggttgggttctggtgaaggtcctctttcagattgcagattgccgagttcttgctgtgtcctcatgtgttgcaagggtgaacaagttcccatgggcctcttttataagtgaactaatcccattcatgagagctctgccatctgacctaatcctctcctaaaggccccactttttaatactattacattggggatttgaattcaacatagaaatttggggaaaacacaaatattcagatgatagtacagaatttcaaattttccagattgacttcttaggatattcttatgctcattatgctaaaaatctctgttcaatattgagcccatttagatgacttgtctgtggtattgtgccaaaatagcctctttttctgcccgtggtcacttctcaagagcccccttctattttagacttgatttctatcatgaaacagggaaaggagtgtaaaaacccatctagctaaaaccaccacccagagcacagaccaggaatccagtgctctgtcaactgctaatgttagtttgtttgaactttggaattaattagatgtatacacacctcctaacaaaatatttaacaattgagtccctatcattcatgtctcttcagtcaacttttaggctcttctttctcattctctgcaaccagaaactgtttccccacctctgctcatcctttaacatgctgtcatactgccttatttccttttaccatcaaactactaaaaagattagtctacaatcagggtatcttttcccactcttcaattcctttcatcttaagcttctacattcttcacctgaaggaaattgcattcttgaaggtctctgccctcataattgccaaataaagtgacattttggtctctcttctcctctatcttcctggaagttttgacaatgttgactaatcactttaaaattttttttctttatatccacagtaagagttgtctttcttcttttatttttctcaatgattctctctctcttttttgctaaagacttctttctaaagtacatgtgaggaaatcacttaagttcctggttctcaacttcctcacctataaaatgaaaatatccattccaaaaagaatcatgaacattaaattatattaggtactccaaaaatataattatcctcctttagtgtaaacatttatcagaattctgtctttggtactatctctcttcatcattgaattttacgaatgagaataaaatctttaccttaagccctcaactctctccagaaccccataccaatatttccaatttgtatatcatgcttcatgttcagtaaatctacaaaaccaaacttatcatgtcatcttctccctcatcaaaataaacatctgttcaattctttcctatccttattagtagcattccaaagtcccaatcaacaaggctcaaatcattagtcatctttggctcccttagacctaatccatctatctactgctaattctttatccaaagtgtctcttgcaccaaagactacataaaatgtataaaacattatagccaagtgttacttatattagcatccaaagtaaaacaatgtaatctgccatatcaacagaaccaagagtacacgcaataaactgatagcctacattgtagttaatgttgaaacactgtaacattgtctgctttccccaaagatagggaacaaggcaataattcttggttttaccacttcattgcatcattttactatagtcacagcaataagaaaaagaaataaaaggcacaaatattagaaaaaaaagtcaaactatcattattataagatgacataaaagaatcctatggaagttattttttaaaaaagcaaacaagtactctagcatttaaataaaattaaaatggtaatataaaactcaactgcatttctacatgccaacaacaaacaattaaaatatgaaagcaataaataatactaaattattaactcagtaaataacaatttttttccttgtagcaaaaattaaatcttgacccccacctcacaccatacacaaagcaatctgagatggattatcgacctaaatataaaaaccagaacgagaaaacttctagaaaaaagtgggagcatatatttacaacctgggacaagtcacaaaaacactaaccatagaagaataaaatgatacatctgacataaaaattaaaatattctgctcatcaaaaggcacttgagaaaatgtttaggcaaatcacagagtaggagaaaatatttagagtgcatacacctgagaaaggacccatatcttgtggggttacagaagaatttataaagaattactacaaataaacaatcacaaagctgaacacccctaaaaaaaagaggtgagcagatacttcacaaaagaagatctaagaattggcaataaccacagaaaaaggtagtcatgatcattagtcaccagaaaaaatgcaaattaaaaccataatgagaaatcatttcacacccagaagaatggctaaaataaaaaagtttaaaaggcgagaatgtggagaaatgaaaattctcacacattgctactggtgactataaaatggaacaacttttttggaaagctgttgggaagctttttataaagttagctattcatctaccctgtgatccaacaatgccattcttatttatctatatgaaaacatatgtttataaaaaacacttacatgtgtatattcatagcatattcactcataatggtaaacaatgggaaacaacgcaaggatcaatcaacaggagaattaatgaacaaattgtaatataccatagtatattaatccaatggtaaaccacttaccatgaaagaaacaacatggattaatttccaaaccattatgttgagtgaaagaaacccaaacagtgatacgcacacagaaaacatactcaccataggattccatttatataaagtccaagaatagccaatcctaatacatgatgataaaaatctgaacattcttgcctccaaggcaggaaggagggcaactaattagaaaggggcaagaggaaactttctggggtgatggcaatgttctatattttgttttgagtggtgttatacctatgtaaataattaaagttcatcaagctatatacttaagatctgtgtatttgattcttcaattgtgaaaaacaagatgtttcacgaggaactattttaaaaacaaagccaacacaagtaacatataactattcagtaaaaagaagataactagaatgtcaatagacctacctaatatatatttcaaagatttttttttcaagtatttaagtacaagtaagtagaaaaattcaggcttgtgggttaatatactggagagaaacaaagagaaaagagtaataaccatttcagtcactctgaatttgaaatagattgcttcacaatctagaggattttaagacgtgaaataactgaaagaaacaaaggtgaaaaagatcaaacacaggatgcagaactaacagctgtgacttagttaatgcatatgctgaataaaaacaaactcaacaaagcactgggaagccggcagcttccaagtaattaactaagcagaaacacatgcaatgtgttatcagccctatctcatattgaaagcaaggactccttcgttacaatggatgctctccatttacaggtagagttacaagaaaataaactacataaaggtatacaagaggcaaaggaaaaggaaccaatttgctacatctaagtagtatctattttcagtgaatgagataaaagttctgccgttacctcacctactcaatatcagtcttcccacaataaaagactgaacacatcagctaatggtcaaagaattgtaaattcatgaataagggtcacatttacatttttattttcaaagttcaacacaagttttaaaagtgaaattatcatttcaatcatattattaatttttaataaataaatttttagaacggtctttaatacccataaatcaatctaactccacactttctgcattttcagagagaaaaccagaattaacaaatatgttagagtattaaacctgtgattaaaatataggcttttatataagttcatcaataattatcttttctttggaacagtagctctcaaccattttccatccctgacacacctgtgatttgtcagaacacagcaggagtctcctgttctatccatccatccatcctctatgcacatcctctagtcttcaaatcctttcctgaaacctcatgtcctacctgaatactctctcataagtatttccatgtgaatatactactccctttctacaatgaatgaggagccccctgaaggtcataactcatatggagaaataagtcatgcaccaatgtctccagggtggaagaaagagtagcctaattgaagttatattctttctgcaattatatatagagaaagaaaatatatagatatatagctgttattgttctattacataaatacaggctgcattggttctaatttaaacaccatcatcctgagttacttaactttctcacttatttgtttttctccttaaagcattgttataacatttaagaaagatggagtcagttactaagataaacatttaagtaacgacagcaccaagaaattgggtcaagatggaatttctggctttaattctacctctagatttcttcaaagataaccaggtgaacctaaactcaattagaatatgcagagaaggatttatgaaataatgcctcagttattcagatcatggatctatagaaaagaatctgtttttcattcattgaatgaccaagtgcatttacattagagaatctacattggtataaaaacaaatatatttaataatgaattttattaacatatataggacaatgtcttacttaaatagctttaaaatgctggaaatgcactagaaacacattaaccccagaaacaccttcatatgagagaaccagtgtcaacgaaaatgacagatagcaactaaatctgggtttagtgaggtttatcttgaagcaaatagaccccatcaaatttccttgaaaaagaggacattttgtaatgagatgaaggtgtcactatgttacccagactggtctagaactcctgggctcaaggtgattctctgcctcagcctcccaagtagctaggattacaaccgtgtgccactgtgcctggcagaagacgacatttttgaaaacatttttcttctccacatattggggcactatgtcaaatgttacctgtgcctaaatgcccctgaacctgcatattccatactcctaaagatgtgtcaaattatacaacctcatgaggatatttttaacctctgagcaggactggaagaggcaaatatactaaagtaaaaaaaaagaaactccaaatcagttggacaatgtagcccctttggagtgccagtgatgttatctataaacactgaaacacaaattgcacttgaattgatgaaggatataggaaacaatttatattaaagtgttctacaaactgcagtggctatccaaaatttaagtgccattttatcaatgaggatgaagattataataaaaatgatctaaaataacttatgttaaacaaggaaaaatattaaacaaatcttgcttatttagacctaaatagtcttaaaagacacattttccctacaatttggctcaaaggatttattcatactctatatctaagtagatgatgaatggcattgattgaatccaaagtcctcctgtcttggattttatgaggcccattcagaacgagccaggttgagaacaccaccaatttcgtgttctgggtccatctgttggcaaaaatataatgcaaacagctttataagtgctattttcaatgaaatatcacagaacagcttgtcccaatgatatttctaaagcttgcctgcaaaccgcctactggaaaatccaactgaaagagaagggagaaaagagagaaatccatagaggaaagagacaggaatggaaaaaagaacaaaggataaagagagactagctagaggactgggaacactggaggaaaacaaggagcaatattaaacgcagacaatattcattgaaaccataagaatagagaagatagagaaatataaaaatcacttgggttggaagacagagaaataatcacaaaccatgcagcattgtccagaagaatgaagacaaaaggatcaggaaacaccagaaaatatgtaacagctcaataattggagcataattattaaaatgttgtgagagaaaaatgatgtaaaatagctatttttctaagtctcactgcttcatgtaacaggcacaattcatttttccaaaaactaatgcagatttcagtgtttatcaccaacttgaaaggaagcaaacatcctcttctgagtcccctcttttaatttagaaatccattgacataccacataaaacagtccaggcattgcaatataagtgatgtacatgcattgattcaaatcaaaacacattagagggaaaatgatgccattctgggcacttacctggggtcgaatgacttttacaatatttttgagggcagtatcaggggatggaggtgaacaatcaggtgttgggcctgttgagctgtttctatggttactagttcctggagtagtaactgctacctcagaggcattatctgtgaataaaaatagaactgccatgaacctaatcactcagtttaccttttaagacttgaaattaattttctgaacataaattgagatttcaacttttaaaactggtatcaattacaagatcataatgaggaatatgctcagtagtatattttaaagataatgctttttgaatgctttgtttccttctaaaatggtaactatcaccccctggaatgttgttctgagacaagtgtattattattcaattcataatgatagattatccagcatagctcttaagactgctactactatatgaataactaaaaccttaccttaactaaaaagaatataattttatgatatgattgggctaaagctttcccaataatctcttaaatgagtattaatatttattaaagtgggagttttatatctccctgatgcataaaatccaaattcaagcctcctcaaatgacttttcctagaaatcccacaaactatagaaaagcaccctagtgaatgaagcttgatgaaaaactgaaatttgtgcaaaatggttttatgatgtagataaacacaaaattatcactcctagataagtatagcaacctatgtggtcaaagctaaatgaataaaatttcagaatctaaattaatcttctcttatgttcagtatttaggaggggggaataaagaaaagatgacttgaaaatcaacaacatgtgtaacatttttttcttaaattcatattaaagcaaaataacatcaaggatgccattttagaatgtttaaaatacttgggaaaggatgaaaattattctataaataacttctggtagcacatagaaaagttattttaacaacaatttggcaaacttcaatagctttttatgaaaactgctgcaagctcaaatctgccaaaaaaataaaaaataaaaagtttacttctctgttgtttttaattagttcccaataattttctttcctagacagttagctgaactgattgcaaaagagactgagactgaattttttatagaccaggaagtttctctgttcctgatcgctgtctacaatccccagtgaaatacaggaattcatcaaggcatcttttcctcataaaacacaaagggatgaattatcataaaactctacctaccatataaaaatataactcagtctcactgaggaatccagacaaaggcccataaaacaaaaaattcaagtatgacacatagaattacttggatgactcataaaataagtcttaaaagtgtccagagcacactcttctaagatttaacagaaaaggtgggatttgaattggcatcacaaaagagatggggtggtcttctgagtagattagaaaaccatgagtcaatactgaaacacacaaaacattagtcagcaagatgctctgattctctccaacctatcccttccttctttcattcatctaaaaactacacatgtaagaacacttatttggggcaactatgagtcaaatattatgttatgttctaaagattaactaggaagaatctctggccaaggactggaggcaggtagggatgaataggttaagcactgaggattttcagggcagtaaaactattatatttaacagtataatggtgagtatacatcatcattatatatttgtccaactcatggaatgtataaatcgagaatgaacctgtataaactataaactttgggtgataatgatgtgtccatgtagtttcatcaattataacaaaggtatcattttggagcagaatgttgatagtagaggaggctttgtgtatgagaatatatgaactttgtaatttctgctcaattttgctgtgagtctaagaagttctaaaaataaaatctatgaattttttttcaaaagaatccctgccctcgagaagtatactgttgggttttttccttttcttttttgagacagggtctcactaccatcacccaggctggagtgcagtagcatgaacacagctcactacagcctcaacttcccaggctcaagtgatcctcccaccttagcatcctgagtatctgggactacaggtgcacattaccacatctggctaattttttgtatttttagtagaaatggggtttcgccatattgctcaggctagtcttgaactcctgagctgtagtgatccacccacctcaacctcctagagtgctaggattatagccatgagccactgcacccagcccaaaagtatactcttaaatgtgtcatcagacatgtaaacaaattacaatgcaatataacttgagaactgataacagataaaggaagcatgataaaaaaaaaacagggtggggtgggggagtaatcagactatggcttggacagaagatagctgtgaaaggcttcagttttcaggcaagaaagctggaacaaaacattagatattagggcatgaaggtaggaagagcacagttgaagctgttatttcatatacaaaaaaactggagataagtttgaatgagtgaaaggaagttttattagaatataaacatacttaattctgtaggcaatgagaaatattgaagactgagcagggagtgacataataatagataacttttattgagcatttattatgtgcagacaagccatgttaaattattttacttattgaatctcatttaatacccaaattaacttacaaaatacattccactatcaccatccctattttacagagaaactcatctcaaagttatattctcagttactggcagaaaaggattcaaatttcagactgatgccatgttacccttctgagagttagcatgtcatagcaggtatgcaaaagatatgcataggtatgattgggttcatagaaacatagcctgaagaagatcggcatagttgaggtaggagcacactctacttcaaaatatagttgaaccaacttccagaaacttaaaaagtagacatagacactatgaaaaataaataataaaaacaacaaaaaagtcaaccataaaaacatctttagggtatgcctttgagtactatatagtataatatttaatatttggaagctggaagatatgttaagactagagacccaagctagaggtcatgacgttagcattttggagttgataagtgattagattctggacatgtgttgaaatgtccagaactgttgaaatagaccaagaatttttttgatggctcctgaatagacaaagcaaccttgaacaaaaagaaaaaactgagcacattacactacctgacttcaaaatatactacaaagctataataatcaaaacaacttgatgctggcatagaaacagacacatcaaccaatggaaaagaacagaaatcccagaaataaatacacatatttttggttaatttatttcaaaggtgccaacaacacacaatggggaaagggcagcctcttcaataatggcattgggacactggatattcacatgcagaagaataaaattagaccttcatctcacactatatacaaaaactaactcaaaatggattaaagctgggtgcaatggtacatgtctgtacttccagctacttgagaaactgaggcaggaagtttgcttgaacccaggagtttaaggccagtctgggaaacatagggagaccactctctaaaaaaacattttcttaattaattaaagacttaagtgtaaaattgaagtggtaaaactattagaagaaaacacagagaaaaacctccacaacattgatttgggcaatgattttttggctatgacctcaaaagcacaggcaagagcaaaaatagacaaatgggattatgtcaaactaaaaagctctgcacagcaaaggaaccaatgaagagagtgaagaaacaatttatgaaataggagaaaatatttgtaaacagtacctctgataaggagttaacatccaaaatatatggaactcaaacaactcatagtgagaaaacaataacctgatttaaaaatgggcaaaggatctgaatggacatttctcaaaagaggacatacaaatggccgacaggtatatgaaaaaaatccctaacaacactaatcatcagagaaatgcaaatcagaactacaatgaaatatcatctcaccccagggaaaatggcttttataaaaaagacaggcaataacagatgctagcaagggtgtggagaaaggggaaccactgtacactgttaatgggaaggtaaattagtacagccattagagagaatagtatggagttcctcaaaaacaaaatatagaattaccacataatccagccatcccactgctgggtatatatccaaaggaaatgaatcattatgtagaagagatatctccactcccatgttattgtagcattattcagtagccaagacatggaattaacttgtgtccattaagagatgaatggataaatggaaagaaaatgtaatatatacatacagtggaatactatgctgccttaaaaaagaagggaattccgttatcagtatagatgaacctggaggaccttgtgttaagtgaaataagccaggcacagaaagacaaatgacacgtgatctcacttatatatgaaatctaaacaaagtcgaactcacagaagcagagaatagaatggtggttaccagggactggggagatgttggtcaaaggacacaaaatatcaattagaaggaataagttcaagaggtttatcatacaatatggtgactatagttaataacaatgtattgtattctttaaaagagtagatcttaagagttctcaccacaaaaaaaatgctaagtatgtgaggtaatacatatgctaatcagttcaatttagctattccacaatgtatacatgttttaaaacagcttgttgtacacaataagtatatataatttttgtctatttaaaaataattaaattttttaaaattattgatgtgctggatatagggagagaaagagagaaatcaagaatgactctaaggcttttggcctgaggaactaaaaggatagagctgccatcagcagaaaagggacagactataggaggagcataaattctctaccatataacttccaatattgccttcccattctctctctccctttggactctattgaagtaatgctagacagactttattcttttaaccatttattctctcttttcattctgtctctctgttgcatttttaatagtttcttctatttattttctagtttattggttctttcttcagctgtgtcaaggctgctatcaaaccattttcttaattttagtagacttttctgttctaaaatttctatttggttcttaatcaagtatatgatgtcagtagtttgtattttttagttcctaaaaacattttcaagcttacttttatattaaaatggcaaatacaattggctttggttttttaatctgataattccagcatctaaagtctttacggatccatttctggatttgtggttctgactcatgcaatcctgttccgctgttagtttcatcatcaattctgtgttgcttattattcaacctgttgttacaagatacacatttaaatataactaactcttagtcttttaataaatgttaatttttaaaagcatcgaaacttatatcctaataccagatgctgaagtctgtgaacaacttgcctgtgtaacactagatcatttatttaatctttctggatttcaagtttcttaactgtaaaaatgcaaatgattaactaccatcttctatcatttacgtgtgcagataaaagaaaagaaaaataacttgtatgtttttaggcacataataggggttttcagtatatgagtttccttttccattatcaaaagaaacaccatcagaattaaaataaaatatggaagatcaaagaaacccagagggaaaacaagaaaacaaatagttatcctttttagacaacacatctagagtacttgcgtgatatttgagagcagtatcttttagctattaacacaaattggtagggacagaatttagttccagaaatagcagatgatcctttgagacattgtactgttcaaagttatccagagaaataggaccaacaggatctatccatctatctatctatctatctatctatctatctatctatctatctatctatctatctagacaaagatttactgtaaggcattagctcatataattaatggagcctaagaagtccaaagatctgcagttggtaagctggaggtgcaggacagcctatgtgtagttccattgtaaatccaaaggcctgagaaccaaggaagttgatgctgtaaattctaatccaaaggttggcagactcgaagtcaagagccaacatttcagtccaagtctggaggcctggaaaaaaacagtgttccagctcaagaggtcaggcaggagaaattcccctttactcggcctttttgttcaattcaggtccgcaatttattgaataaggccaataacagtagggtggatgatttgctttactcagtctgccattcaaatattaatctcatccaaaaacaccttcacagatacatcccaaataatgtttagccaaatgtgtgggcatctcacggactagttaagttgaacttataaaattaaacacaacaggaatgattcattgcaagggctggtcttaactgcttttgcactaaagccagaagaaaatgctgggaactccctgcaaactgtaagccaacagcttcttgaatgttttttttctgagtattttaatacatagtataagacagtggataattaagtactaaattatttagaaaagactaagtatcttcatcttctgaatccatgagctataccattacactgataatttgattttgtactatcttgcattgttcattaactcttccagactaggttatatttttgcataaagtcatatttctctctatatagctcttagcttaatgcaatccttttaaagtaataaatgaagtaaagtagataaagcaaaacctgtgtcaatggaaaccaacacaaatgtatttaataatatgaagaaagctggtctggcttttataataattccatgatcctttcaaagaaaatccaaatgagaagcatattctagaagatatatgagtcttaagaagctggtttattcccaaaatatccttgataatataatttacaaaaaataccaattatccagtggacttggtaaaatagcagcctatgaccaagacagttttacatgctcaacctacatttcacatatgcagttacaaaatattgctgataaaaaggaaatgaggcacataaaactgcttagggaaaactgcaaaatatacttgcaatttcagattgaaataagaggactatcttcttgtcagattcccttactacatattaattattcattatgaatgtcagtttagtctataataacaacattagaaaaaatacttatagtttattttatcttttagaagaaaaatattctatgactataaaataattcatgtgcaacattacagtctagtattttaacatcaatacccagcatgtaacaaacagtttaagtataccagggaccatgatagatgcttttcagctgaagaataggactgagattacttctggctgggaattcaagaaagctgtcatggaagaggcaggagttatgaaggcctctgacagactagtaaaattcaggcatgaagaaatggctgggaagggcgttccatgagttggaagcaggttgagcaaaatgtagagagatgggaaagaggcacatttgtggaataaagaagagttcagtttgaataaaatataatattcatggaggaaatgctaagaaatggaggagtcatacacaaagactttgggctttgaaatcagaaaaccctaagctgaaattctggtatatttaacttcagtttcatcttctgtaaaacagtgcctttcacatagtgttacaaagacaaatgaggcatgtacagatacgtgtgtgtgtgtgtgtatgtgtatgtctgtgtgtgaatacattgcctgacacatagtaagtgctcaataaaattatctattactattattatcagatatatgaatataatcataatagcaaataaaactagataggtggcttgatgccttattatggaaaatcctaagtgcatcacttgcatcactaagtaatcatcaaatataagtatttaataaatcctaatctaacaattcatgaagcacaatttttacgttttggtattaagtcaagagttgacaaattttttctgtaaagggccagatggtaaatattgtaagctctgtaaggctacatgatctttgttgtaactactctactctctttgggtagcgagaaggcagccacaggaaatatataagcaaatgggtgtgtccgtattccaagaaaattttacttacaaaaacaagcagtagacaagattaagtttgttggtgataacttgtagatccctgtcttaagtacttcctatggaaatgttttcccttttatggacagacctagaagaatgttatattatacattttcatttccatattcatattatagatgaacattctcactgtgtaattaaaaactaaggttttcaatataaagctagaaatttgtcatttgtacaaaaaatggcattatatctaacaccagggcagtcctttgtacacagcaactgttcaatatatgctcattaaatagataaataaataagaccaatgaaatctttacattttaaagtaactttgttgtagtgattgtacatgactaccacttctgggagaaacagtacagaaatcataagtaaaaaagcccaagtatcctgtttcagtattttcagtgagaaagtactcactatgtaccacttgaggaagataatatttaacagtaatttaagagaattagttaataatccaaataattaacacattttactttctctagtgaaggtttgttaaaaagtaacaattctcttaaatataccgggtttgaacttccattactatcaccaacaatagtgttaaatattcaagtcttaattagccagcaactttaccagatgaaatgtgtggtagacagcctctaggatggtcccaattgagccccacctcatggtattcacacttttgtgaaattttgtcccctagggtgtgagttgaactcgttgaattgcttctaacaaagaagagatgaggccgggcacagtggctcacgcctgtaatcctagcactttgggaggccaaggtgggcggatcacaaggtcaggagatcgagaccatcctggctaacatggtgaaaccccgtctctactaaaaatacaaaaaattagccaggcgtggtggtgggtgcctgtagtcccagctactccggaggctgagccaggagaatggtgtgaacccgggaagcagagcttggagtgagccgagattgcaccactgcactccagcctgggtgacagagcgagagtccgtctcaaataaaaagaataaaaaagaaaaaaaaagaagagatgagttgtacttctgggaataggttataaaaaaagactgtggcttccgtcttgtgtgtgtcctccttctcagatctcttgcactgaggaaagcaagtaaccacattgtgaacaaccttatgcaaaggcctacgtggcatggtaaggagctgaggccctcatttcaacagcccaccagaaactgaaccttgttaacagccacgagttagcttggaagcaaatccttcagccccagtcaagccttgaaaagactgcagttctagccaacagcttgcttacagcctcccgggaaatcttgagtcagaggcatcccgctaagtccctcctagtttcctgaccctgtgagataattaatgtttgttattttcggccacaaatagcaatagataactaatatagtaaatgtttggttaacgtttataacatggccaacatgtttgtgctacaatggtgcttagactttcagccttgttttgaaggagctgactacttaatggaaaacatagaagggcaaatataattacaaaattgtgttacttatgctacaaattcagcaatatgggaacacagaagaatgagccactaaccaaatgagggggccagagcagaaagttaggttataggcagaaagagaaagtgaagaaaaaaaatgtaatagccttgaggaatgagtgccatcaagaactcaaagagggagaagcattccaggcaaagaaaacagaatatgcaacagggcagaagcatgaacgagcattatgcctttgggaagctataaatagttcagcttggctgaagcacaggatatgtgtggaaaagtgaatggagatgatgttggcaagataaagtattcagatgaaagatggaaaggtgtataaaaagaaaacaaaattgcctttgtaaaagattaaatttttctatttaggaaaaaaagtcagccacattgcatttctaaaattactttccttgaggctatgatcaaatgctactttcatctataaaaagaacagaccacaaggctatagtcactttaaaattctctgcatgcaagaggccacatctgtgtgctaaagagtagaatgattgactagcagcttcaagccaataagaactttggtcttatctacaccagagaagttctagcaaagagtcaaaaactcgaagagttagaggacatctaaaagtccaagatctcaattcaaacataaaaagcagtgcaatgaacagatggttgggagagtgtgctctctcccacctttcctttacttttgtttcctcctctttctcaacccatggcagggagatggtcttttagcataataattcaccagaggtatgctgtaattggtgagcaatattagtaggagaaatgtttccttgtcttataaattctctactctgaagaatctcaaggatttatgagaaatgcaggagtcttgtagaattttaccttcctcctcccaggatgatgccaagaatgacaattccctggccttggctagcaagactgaactagaatcctggagaactgcacagttaagaaaatgaaagagaaagggaggccatagaagatgggttccctcccaatgcttacttttatggactaaatgttaagcaatgaagaaagtaaaaaagaaagaaaatattttgcatcacatcagtaatccgtggattctctgttttactaatgcacttgtgcttcaattcttattttggctcttcaggctctcctggttttgagtcccattttaggttgtatgctttcccttttgtcttaacaacctattcttttctccggttgtactcttagtggtccctgtattcatcttctatatctttctattcattccaaaattatgtaaacacccaacctgaccaagacacaccctagcactagcccaccaggccagaacccctactaagtagccactgactctctatgaaaggaagttagaaaatgaacctgctgagagtaaagggggaaaaaggtggataggaggcaggactaacttgcagctgccactcagatggacagagcagcatgtggagacccacatcatgaacttttgctccaagaactaccataggaacataccaggaaagcagagaaaaccacagaccctttgaaggagtagattgccactgcaggctctgtgagtcagcttgctttctcagcagggaggtttgtagcctggggcaagttcttagtcctgctcataggctgcctggaaataaacggtgctgttggcagggcacagtgggaatgagactggccttttgggctgtgggctgtgtgggagttgggtgaggtctgtggctgctggctttccaccactttcctggtgacctgtgcgactcagcagaggcagccataatccccctgggatataactccattggcctgggaactgcaaccccacccccaacagtagccacagcaaaccccacccaaggagagtctgagctcagacacacctaaccctgtccccacttgatggttattgtctgctggccctggtagctgaagactaaggacataatctcttgggaactctatggccccacccacggcctgatccttcctatactactgcagctgatgtgctattgaaagcaccacctcctggcttgaggacaaccaaaacaaaaccagcgcacttaacaaaaatacaaccaaggaccctcagagagtccacttcactctcctgatacctccaccagagcaggtgctggtatggtatccacagctgagagacctgaagatgggtcaaatcacagaactctttgcagacactcccagtaccagcctggagcccagtagctccactgggaggctagattcagaagaaaaataacagtcacttcagctctcaggaagccccatccctaggggaaagggaagagcaccatatcaagagagcaccccattagacaaagaatcttaacagaagcccttgagtcctagatcttctctctgaaatagtctacccaaataagaaggaaccagaaaaaaacaattctggtaatatgacaaaacaaggttctttaacacctccaaaagaacatactggcttaccagcaatgggtcaagatcaacaggaaacctctgaattgccagaaaaagaattcagaaggtcgactactgagccaatcaaggaggcaccagaggaaggttaagtgcaacttaaagaaatcaaaaaagatgatacaggatatgaatggaaaaatctccagtgaaatagatagcataaaaaaaatcacaacttctggaaatgaaggacacacttagagaattacaaaatgcactgggaagtctcacaatagaatcaaacaagtagaagaaaaaaacttcagagcttgaaatcaaggctttcaaattaacccaatctgataaagacaaagaaaattttttttttaaaatgaacaaggcctccaagaaaatttgggattatattaaatgatcaaacctaaaactaattgatgttcccgagggagaatagaaatctaaaagtttggaaaacatatttgagggaataatagagaaaaactttcccagccttgctagagatctagacatccaaatacaaaaagctcaaaaaacacctgggaaattcatcacaaaaagatcatcgcctaggcacctgatagtcatcaggttatctaaagtcaagatgaagagctgtgaggcaaaagcatcagataacctataaaggaaaacttatcagattaacagcagatttctcagcagaaatcctacaagctagaagggattggggttctctttagcctccttaaataaaacaattatcagccaagaattttgtgtccagtgaaactaagctgcataaatgaaaaaaagatggtgtttttcagaaaaataaacgctgaatttgccactaccaagccatcactaaaagaatggctaaaaggagctctaaatttttttttaacctctaaatcttgaaacaaatcctcgaaatacaccaaaatagaatctccttaaagcacaaatctcacaggacctataaaacaacaacactatgaaaaaaaaaccaaggtattcaggcaacaaatagcatgataaacagaacagaacttcatgtcttaatattaacattgaatgtaaatggcctaaatgatccacttaaaagacacagaatggtagaatggatgagaattcactagccaagtatctgctgtcttcaagagagtcacccaacacataaggactcacataaacgtaaggtaaaggggtgaaaaaagatacttcatgcaaatagacaccaaaagcaagcaggagtagctgttcttatattagacaaaacaaactttaaagcagcagcagttaaaaaagacaaagaaggacatacataatgataaaatgactagtccaataggaaaacatcacaaacctaaatatacatgcacctaacactggaagtcccaaatttataaaacaatttctactagacctaagaaatgagatggacagcaacacaataatagtcggggacttcaatattccacagacagcagtcaggtcttcaagacagaaagtcaacaaagaactataccctagaacaaatggactaaacggatatttacagaacagatatttacagaatattctacccaacaactgcagaatatacattctactcatcagcacaggggacattctccaagatagaccatatgataggccataaaacaagtctcaacaaatttaagaaactcaaaatcatagcaagtactctctcagagcacagtggaataaaattggaactcaactccaaaagaaaccctgaaaaccatgcaaatacatagaaactgaataacctactcctgaatgattactgcataaacaatgaaatcaatatgaaaattaaaaaatttacactgaacaataatagtgacacaacctatcaaaacctctgggatacagcaaaggtggtgctaagagaaaagttcatagcatcaaatgtctacttcaaaacatctgagagcacaaatagacaatctaaagtcatatctcaagaagatagagagacaagaaccaaacccaaatctagaagaaaaaaagaaataaccaagatcggagcagaactaaatgaaattgaaaaaaaaaaaatacaaaagataaacagaaagctggttctttgaaaagataaataaaattgatagaccattagcgagactaactaagaaaagaagagagaagatccaaataagtgcaattagaaatgaaacaggagatattacaaccaatcccacagaaatacaaaagaccatttaaggttactatgaacacttttatgtgcataaactagaaaacctagaggagatggataaattcctggaaatatataaccctcctagattaaaccaggaagaaatagaaactctgaacagaccaacaacaagcagcaagattgaaatggtaattaaaaagttaccgagaaaaaaaggccaggaccagatagatacacagctaaattctctcagacattcaaagaagaattggtaccaatcctgttgatatctattccaaaagatatagaaaaagagaatcccccctaaattattctatgaagccagtatcaccataataccaaaaccaggaaaggacataacataaaaagaaaactacagaccaatatccctgattaacatagatacaaaaatcctaaacaaaatattacttaactgaatcctacagcatatcaaaaagataatccaccatgatcaactgggtttcatacaaggaatgcagggatggtttaacattcacaaatcaataaatgtgatacaccacataaacagaattaaaaacaaaaattacatgatcatctgaatagatgcagaaaaagcatttgatgaaatccagcatccctttatgattaaaaccctaagtaaaattagcataaaggtcattcgttaatgtaataaaagcatctatgacaaacccacagccgacattatactgaatggggaaaatttgaaagcattccccctgagaactggaacaagacaaggatgcccactttcaccacttctattaaacatagtactggaagtcctagccagagaaatcagataaaagaaagaaataaaggccatccaaatcaataaagaggaagttaaactgtcactgtttgctgatgacatgatcacatacctaggaaaccctaaaggcttatacaaaaagttcctagaactggtaaatgaattcagcaaagtttcaggatacaaaattaacatacacaaatcagtagccttgctatacaccaacagttttcaagctgagaatcaaatcaagaactcaaccccttttacaatagctacaaaaaaaaaaattaggaatatactcaaccaaagaggtgaaagcctgctacaaggaaaactacaaaacattgctgaaagaaatcatagattgacataaacaaatagaaacacatcccaatctcatgaatgagcagaatcaatattgtgaaaaatgaccatactgccaaaagcaatctacaaattaaatgcaattcccatcaaattaccaccatcattcttcacagaactagaaaaaacaatcctaaaattcatacggaccccaaaaagagcccacataaccaaaacaagactaagcaaaaagaacaaatccagaggcattacattactgaacttcaaactatactataaggccacagttgccaaaacagcatggtactggtataataacatatggaccaatggaactgaatagagaatccagaacccagaacccataaataaagccaaatgtttactgtcaaccagtctttgacaaagcaaacaaaaatataaagtgcataaaggacaccctatttaacaaatggtgctgggataattggcaagccacgtaaaagaatgaaactggatcctcatctctccccttaaacaaaaatcaactcaagatggattaaagacttaattctaagacctgaaaccataacaattctaggagataacattggaaaaacctttctagacattggcttaagcaaagacttcatgaccaagaacccaaaaacaaatgcaacaaaaacagagataaatagatgggacttaattaaactaaaaagcttctgcacagcaaaagaaataatcagcagagtaaacagacaacccacagagtgggagaaaatcttcacaatctacacatccaacaaaagctacaaggaactcaaacatatcagcaagaaaaaaacagtctcatcaaaaattgagttaaggacatgaatagacagttaccaaaagaagatatacaaatggccaacaaacatataaaaaaatgctcaacatcactaatgatcagggaaatgcaaatcaaaaccaaaatgagataccaccttactcctgcaagaatggccataataacaaaaaaaaaaaatggatgttaacatggatgtggtgaaaagggaacacttttacattgttgatgggaatgtaaactaataaaaccaccactgaaaacagtgtggagattcctcaaagaagtaaaagtagatctaccatttgatccaacaatcccactcctgggtacctacccagaggaaaataagtcattatacaaaaaaagatacttgcacacacatgtttatagcagcacaattcacaattgcaaaaatatagaaccagcccaaatgcccatcaatcaacgagtggataaagaaaatgtggtggatatatacatgtatatatatatatatatacacatacacacaccatggaatactacttagccataaaaaggaacaaaataatggcatttgcagcaacctggatagaactggtgaccattattctaagggaagtaactcaggaatggaaaaccaaacatatgttctcactcataagtgggagctatgctatgaggatgcaaaggcataagaatgatacaatggactttggagactcaggggaaagagtggaagggcagtgagggataaaagtctacacattgggtacagtgtacactgttcaggtgatgagtacaccaaaatctcagaaatcaccactaaagaacttattcatgtaaccaaatacgaactgtttcctaaaaacctattaaaattaaaaaaaaagaagaagaaaatgaacttgctaaatccctgaataaaatatcacagtagttggaggtgaaatgacattcattcttccacatgacagtgtaaattccagtagtattccttcacactcatttaaaaatgagtctaatctcatcagatgatgctatagtccatacttcctcatagctataatttatgaacttctttttactctcttttatttatcagagaattagcatgtatctcccaatcttgctttccacctcaagcctatcatcattttgggaactgtcagtttcctcgtacattttcaatcaatctcttgagcctgagtgttttgatttctacttacgtaatctttgctttaattctattcagattaccatgtctaaggctaacccatgtatttcattatgaacagcaactacttcatatagatatttaatctctagtaactcattctgtggatacaatgtccaatcacttcctctctcttccacactacatctattgtttaatcccatctctatccttttatccatctagtttcatccaacctatcagtccctttccatcttcacatttacttatttagtttagacacaatggcccatcacttaacaactctcttgccagtaactacattcactcttgttattttaccacatacactgagcaaaaccctattcctatttgcagttgacactttaatgtaccacccagattcaacttcagatataaaacatttattctcctagctgtatgatgtgttgctggcagacagtcttcagctgtcagctttcttttggaattgcctcaactgaagagaatggactgacccaaggccatgcccccttccaggtgcaagctgctttcaatgtcaggtcaacacaagtgtataatagtcctgtcctatcgccaacttggaatgactttgaagagtcatcccagtttcagaattccctagggagcctttggatggctatattgagacttcatcacagcctgatctctccagctgccatttctggcttccctttaacaggtgttgcctccgaaatcactcaataaatctcctgtatgctaacctacatctcaaagtcagctttctggtgaatccatcttggattgaactcagttgttctcagtggccccttctgcatctttttaaccaattaggtactaatgactgagacagaaaaatcatacaactgctagaaattaatgttatcaaatgatttgatattctctgatatggtttgtatacttgtctcctccaaatctcatgttgaaatgtgttccccactgttggagatgggcatactgggaggtgtttgcattatgggaatggatccctcatgaatggcctggtgccctccctgtggaggtcatgagttaccatgagatctggctgttaaaaagagtctaggatctacctcttctctcttgctcactctctcatcatgtgatatgccttctccccctttaccttccaccatgagtaaaggttcctgaggcctcattgtaagctgagcagatgttcatgccatgcttgaacatcctgcagaactgcaagccaaacaaacctcctttctttataaattactcagtctcaggtattcctttacagcaatacaaaatggaataacacatgctttcacaaataattcacacggtgaaaaaaataccctaatagaaaactggactaaaaactaccaacaggcacttcacaaaagaaaagtacaaataaatgtataagccttttgcctcagcttctgctcaagcctttgtataggaatgcatggatggaatacagtcttctggttttgttttgattaatatgtgaagacaagatattcacaagcttaaacattcaaatgcggcagccaagatggccgaataggaacagatccggtctacagctcccagcatgagtgacgcagaagacgggtgatttctgcatttccatctgaggtaccgggttcatctcactagggagtgccagacagtgggtgcaggacagtgggtgcagcacaccgtgcgcgagccgaagcagggcgaggcattgcctcacttgggaagtgcaagggggcagggagttccctttcctagtcaaagaaaggggtgacagatggcacctggaaaatcaggtcactcccaccctaatactgcgcttttccgacaggcttaaaaaacggtgcaccaggagattatatcctgtgcatggctcggagggtcctacgcccacggagtctcactgattgctagcacagcagtctgagatcaaactgcaaggtggcagcgaggcttggggaggggcgcccgccattgcccaggcttgcttaggtaaacaaagcagctgggaagctcgaactgggtggagcccaccacagctcaaggaggcctgcctgcctctgtaggctccacctctgggggcagggcacagacgacaaaaagacagcagtaacctctgcagacttaaatgtccctgtctgacagctttgaagagagcagtggttctcccagcacgcagctgcagatctgagaagggacagactgcctccccaagtgggtccctgacccctgacccccaagcagcctaattgggaggcaccccccagtaggggcagactgatacctcacatggccgggtactcctctgagacaaaacttccagaggaacgatcagacagcagcattcgcggttgatgaaaatccactgttctgcagtcactgctgctgatacccaggcaaacagggtctggagtggacctctagcaaactccaacagacctgcagctgagggtcctgtctgttagagggaaaactaacaaacagaaaggacatccacaccaaaaacccatctgtacatcaccatcatcaaaaaccaaaagtagataaaactacaaagatggggaaaaaacagagcagaaaaactggaaaccctaaaaagcagagcacctctcctcctccaaaggaatgcagttcctcaccagcaacagaacaaagctggacggagaatgactttgacgagttgagagaagaaggcttcagacgatcaaactactccaagctacaggaggaaattcaaagcaaaggcaaagaagttaaaaactttgaaaaaaatttagatgaatgtataactagaataaccaatacagagaagtgcttaaaggagttgatggagctgaaagccaaggctcgagaactacgtgaagaatgcagaagcctcaggagccgatgcgatcaactggaacaaagggtatcagtgatggaagatgaaatgaatgaaatgaagccagaagggaagtttagagaaaaaagaataaaaataaatgaacaaagcctccaagaaatatgggactatgtgaaaagaccaaatctacgtctgattggtgtacctgaaagtgacggggagaatggaaccaagttggaaaacactatgcaggatattatgtaggagaacttccccaatctagcaaggcaggccaacattcagattcaggaaatacagagaacaccacaaagatactcctcgagaagagcaactccaagacacataattgtcagattcaccaaagttgaaatgaaggaaaaagtgttaagggcagccagagagaaaggtcgggttacccacaaagggaagcccatcagactaacagctgaactctctgcagaaactctacaagccagaagagagtgggggccaatattcaacattcttaaagaaaagaattttcaacccagaatttcatatccagccaaactaagcttcataagtgaaggagaaataacataccttacagacaagcaaatgctgagagattttgtcaccaccaggcctgccctaaaagagctcctgaaggaagcactaaacatggaaaggaacaaccagtaccagccactgcaaaatcacgccaaattgtaaagaccatcgaggctaggaagaaactgcatcaactaacgagcaaaataaccagctaacatcataatgacaggatcaaattcaaacataacagtattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggaaggggttgcaatcctagtctctgataaaacagactttaaaccaacaaagatcaaaagagacaaagcaggccattatataatggtaaagggatcaattcaacaagaagagctaactatcctaaatatatatgcacccaatacaggagcacccagattcataaagcaagtcctaagtgacctacaaagagacttagactcccacacaataataatgggagactataacaccccactgtcaacattagacagatcaacgagacagaaagttaacaagaatacccaggaattgaacccagctctgcaccaagcagacctaatagacatctacagaactctccaccccaaatcaatatacatttttttcagcatcagaccacacctattccaaaattgaccacatagttggaagtaaagctctcctcagcaaatgtaaaaaaacagaaattataacaaactgtctctcagaccacagtgcaatcaaactagaactcaggattaagaaactcactcaaaaccactcaactacatggaaactgaacaaactgctcctgaatgactactgggtacataacgaaatgaagacagaaataaagaaggtctttgaaaccaacgaaaacaaagacacaacataccagaatctctgggacacattcaaagcagtgtgtagagggaaatttatagcactaaatgctcacgagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaataaatccaggagctggttttttgaaaggatcaacaaaattgatagaccgctagcaagactaataaagaagaaaagagagaagaatcaaatagatgcaataaaaaatgataaaggggatatcaccaccgatcccacagaaatacaaactaacatcagagaatactacaaacacctctatgcaaataaactagaaaatctagaagaaatggataaattccttgacacatacaccctcccaagactaaaccaggaagaagttgaatctatgaatagaccaataacaggagctgaaattgtggcaataatcaatagcttaccaaccaaaaagagtccaggaccagatggattcacagtcgaattctaccagaggtacaaggaggaactggtaccattccttctgaaactattccaatcaatagaaaaagagggaatccttcctaactcattttatgaggccagaatcatcctgataccaaagcctggcagagacacaaccaaaaaagagaattttagaccaatatccttgatgaacactgatgcaaaaatcctcaattaaatattggcaaacctaatccagcagcacatcaaaaatcttatccaccatgatcaagtgggcttcatccctgggatgcaaggctggttcaatatacacaaatcaataaatgtaatccagcatataaacagaaccaaagacaaaaaccaggtgattatctcaatagatgcagaaaaggcctttgacaaaattcaacaatgcttcattctaaaaactctcaataaattaggtattgatgggttgtatcgcaaaataataagagctaactatgacaaacccacagccaataccatactgaatgggcaaaaactggaagcattcccttgaaaactggcacaagacagggatgccctttctcaccactcctattcaacatagtgttggaagttctggccagggcaattaggcaggagaaggaaataaagggtattcgattaggaaaagaggaagtcaaattgtccctgttcgcagatgacatgattgtatatctagaaaaccccactgtctcagcccaaaatctccttaagctgataagcaacttcagcaaagtctcaggaaacaaaatcaatgtacaaaaatcacaagcattcttatacaccaataacagacaaacagagagccaaatcatgagtgaactcccattcacaattgcttcaaagagaataaaatacctaggaatccaacttataagggacatgaaggacctcttcaaggagaactacaaaccactgctcaatgaaataaaagaggatacaaagaaatggaagaacattccatgctcatgggtaggaagaatcaatatcgtgaaaatggcatactgcccaaggtaatttatagattcaatgccatccccatcaagctaccaatgactttcttcacataattggaaaaaactactttaaagttcatatggaagcaaaaaagagcccacatcgccaagtcaatcctaagccaaaagaacaaagctggaggcatcacggtacctgacttcaaactacactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacattaaacctaaaaccataaaaaccctagaagaaaatctaggcattaccattcaggacataggcatgggcaaggacttcatgtctaaaacagcaaaagcaatggcaacgaaagccaaaattgacaaatgggatctaattaaactaaagagcttctgcacagcaaaagaaactaccatcagagtgaacaggcaacctaaaaaatggaagaaaattttcgcaacctactcgtctgacaaagggctaatatccagaatctacaatgaactcaaacaaatttacaagaacaaaacaaacaaccccatcaaaaagtgggcaaaggatatgaacagacacttctcaaaagaacacatttatgcagccaaaaaacacatgaaaaaatgctcatcatcactggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgcaaactagttcaaccattgtggaagtcagtgtggcgattcctcagggatctagaactagaaataccatttgacccagccatcccattactgggtatatacccacaggactataaatcatgctgctataaagacacatgcacacgtatgtttattgcagcactattcacaatagcaaagacttggaaccaacccaaatgtccaacaatgacagactggattaagaaaatgtggcacatatacaccatggaatactatgcagacataaaaaaggatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaggggaacatcacactctggggactgttgtggggtggggggaggggggagggatagcattgggagatatacctaatgccaaatgacgagttggtgggtgcagcacaccagcatggcacatgtatacatatgtaactaatctgcacattgtgcacacgtaccctaaaacttaaagtataataataataaaatttaaaaaaaaattcaaatgtttcctcttttacctcattatgatttctttcaaggcagacacaatgtgtctaatttgtctttatatcaccattacacattacagtagaattcactttattaggagtcaggactcaatttttgaacagtcagagtattacggacaaaacaatatttcatgtatttttaaacaaagtatttcacatcatttacttaatatctatatttgttaaatactgatgagaacaaaatttcaagtatctagaatttagcaaagaagttaaatgtccaactaaaataagtttaaatttaaatgattaaattgtttgttgtatttcagattctatccattttactttaatagaaaaatatcattcataaaaaagtttggctggccacagtgactgacaccaaaaatcaaagcattttgggagactgaggtaggaggattgcttgaggccaggagttccagacaagcctgggcaacataggagacccccgtatcttcaaaaataaacaaattagtgggatttggtggtacaggcctacagtcccaacttctcaggagactgaggcaggagaatcacttgagctcaggagttttaggcggccgtgagttatgattatcccactgcactccagcctaggtaacagagactctgtctctaataataataataataataataataaagttttcatgaaaaaaagaaatattaataaaatttcctaaattggagacatgcactcattatccacatatatcaacattggtcttattttcattatggtatactgtatgagctatggaaattattaagtatcaagcattaaattacctgccaattcttgttcattatacaatcactggtctcagaagaacataatcattacaaagacaacttcaaaagtaggagtgactatctttaatgctttaatgacattgtagagcatcacatcatgatttgttatggagtttagttttcctcttaattactatcacacttcaatctaaatgaatttagatttcatgtaacattttgactttttggaaggtcatggtttcttcattagtaggcaaaactcctacttaggaaagctatcaattcctcaattctcctattatttttatacatgtggttatagtttaatagattacttcttttatatgcccactgcagcatgtgaattttatgctaacaagagtgtgcacttaggcacacatgcaatatagctatgatatgtctatcatataaattaaatatgtgccaagtatttcatggagctaatacattttactcaaaatgtcagtaaattctagaaaaactggatggaaattgccaattataaaatgagagttttgattgaagtccacattagccaggaacccatactttggttacctgatattttggcataaatgtgaccacatattcatcttactatattattaccatatgaacatatatttcctttgaaatgctatcatgttcttcaagttatatgaatactaatgataagagatcttacatgttataaaaggaatacattgtatggaattacaatttatttagacatactttgggaaaagtttgattgcatttcatatgcgttcataaatcaaattgaactgtttcaggattttcaggaagcaaaatgacaaccaaaagtataatttaatcctaaagcatctttcctctttttttcttaatactcacagctaaacttaactgaaagtaaagttttcattctaagctttccaggttcattaaattgttcctatatcctcacaaaatcatgatttttgtttaaaatttaaggacatttttgttgttgttaacaaaatattgcttaaatacttgttatacatcatatatatttatgagtccaaaagtacctagttattataactttggaagcccagagtcctgtttaaaaaaaaaattagatgtcacaaaaggcctctgagctcttgatgaatgtgttataagttttgtgtacatcttaagggacctctttcacaagcaaccagaagtccttttgtaattacttatgctcaacatctatttctaatttgcagagctatgatgaggaacatccccagttcacacaccacttggcaactctgaactcactgatcaatgtgtcagtagacaggtttgtaatgagtagacataaaacaacatatcacatatgcgtgcacacacacacacacacacacatacacacgctctttaaagtgctttgaagtgtttactctttggtctgctactcatggaccaaatattattaaaaaatatgttgctgctactcttccaaatatacttaaaactctgacatgtaatgcaggttttcctataatctgtgaaatccctgctgcctttcaaaaaaatcattctaataaaaacagagataaatttacccagaagagtaaactagcatgaaatgccctgtttttgctgttgtcacaattcattgttaagttatttagtggtcccttattaaatgcccttagaattcgtagtgcaaaacgtttttacatagaatgggagtcctatatgacatattttaatttttacatggaatgacattcctatataacaaattttaatcctgttaatttaactaattacataaacctaaccaccacagtaaattatagtctgacctaaaagaaaatatggcatgagctgagacaaaatgtatccagttctcagaacatatctatgtctcctctaatttgtaggtcttttttcctttgtatgacactccacttaaatatcctgccggacctagctcaaatgctattttttctgcagcgtcttctctggctcggtcagtcagtaactgatgtttcttccatcatttcttcatataagatcaggctcattacattataattatttaggtatccctctgtctccctacagagcgtgagctccttgaaggcaagaacctttttacattttctttacactctcagacctaagtatagtactggatgttaaattaataaatacatgcaagatactatatcaactaaattagatatttcaaaatagttttgttgttgtaacaaaaattggatgttttgtagatgtttataattctgttttcattttaactaatacatagagttccactttattaaaacatatcctttgattaccttatagctagacacagaaggaggaaaataggagggtaaaggattttaaaagcatttggggatttttaaaaaaggcttccagagactaataaatcactgaacagtagtaacaatgctgtcatcaccaatctctatacaccgagtttcatgcagcatttaagaaagcctatgagttaaactgcgcttaaaataagatatatatttgcttttaaccatgtcaaattgtgcatgaaaagaaagtccttgaaggcactataccaaatgttataaagctcacctctggctggagagattatggattaattttttaaaatatttttcctatttccctaatattcttctaagagcatgtcttactttgatttacttatatttgtttcaaatattggctattattttttaaagcattacagatacttttaaaatctcttttatatcctgtcacaaacctatttccatgttgccttcatgagttaatcaccatcctgaagttggtatgtattatccgtctgtgcctttatacttttactatttatgtatatagtcattagacatattaattatgtcacagacatattgtgttttaaatttacattaatatcatatgacaattctgactcctttttttcatttaacactttcaatatagatccacatggatgtttataatcctactgttttattttaactaatacatagtgttccattttattaaaatttatcttttgattattttatgaatagacattttgttttttcgtaatttttcattcttacaaacaatattgcagtgaatatccgtgagagacttaaagttttcttttcaagagccatacctagtagtacaattaattgatagatagaagagtatgtgcatttcaaacttttaaaaatattgatgaattgtcatccaatgtggagtaccaatttatagtcctatgagaattcctgtttttctatatcctttacaatacttgatattgtcagaactcttgttttctgtctttctagtagatggaaatacaactggcacctcattggggccttaatttaaatgtccctgttacctgtgttaactatgtttattggttattcaaaattcattttcagggaattgtctttgccaattgtttccattctttgtttgctttttgttgttgtcttttccttactttgtagtgcttataccttctcagtatgtgcattataaacatctttcccagtttgtggcattttaaaagtattttgtgacatgtcatgctaagcatgagctttaatgtaatcaatcctaccaatcttcttaatgatgtgtactttttgtcttgtgtaagaaatccttccctaaactaagatgtccatgtggattactttttttaatttgttaaattgaggaattatattgaaagatttttggtggctgaaatatccttagaagagtgagttaagttctacttagtatgatctacgttttaatgcattattgaattcaatgtggtaatattttgcttagacttagtacatctgttttcacgcagagattaatccatatatactgttcttgtactctccttgtccattttcgtatgtaagtcatgaaagtacaaagttgggtagtttacttctttgtacactctcttcaacagtttgtatagcattggtattatctgttcattaaggtttgataaaactatcttatcaaaccattttgcaattctattctgttaaaatttactgagttatgactagtaattagtacttttcccagaaaattgtacattttatgtcttaaaatataaagaagaaattaataaaatcaagtatatcagtggttacattaaatataagtagaattatccccaataaaaaccaaacatggggctaaaaagttagacacatttttttaaaaaagttctatcctgctcattagaaatacacctaaaataaaataaagctggaaataaatagaaaagaagtgaaaagcaaaggcaaacaaaataacagaaatgaaaatattaaaatatataaggtcatattttagaattaaaattgttaatagaaataaagggaatactatataatgacaaacatgaagaaatttataaagcaattgtggtatcattctaggagtaaaatcctggaaactattttatctgaaacagaaaccagactcaaatgccttccattgccatttgttcaacattgtcttgaaggttctactaaatatatcaaagtgggaaattaaataattactataaatattggggaaaagagtgaaaatatttatttttgttgattacatgattatatatccaaaagcctctataaaactcaaaagccggctgggtggggtggctcatgcctgtaatccaagcacactggtaggccgaggtgggcagataattttaggtcaggagtttgagatcagcctggccaacatggtgaaatgccatctgtactaaaaatacaaaaaaaaaaaattagctaggcatggtggcacacacctgtaatcccagctacttgggaggctgaggcaggagaatcacttgaacccaggaaacagaggtttgcagtgagccgagatcacaccactgcactccagcctgggtgacagagtcagactctgtttcaaaaaaaaaagaaaaaaaaaaaacctcaaaagcttaagttttaaagtaaaatatattaaaattaaaataattttgtaaggtagctgaatacaactaatatattaaaaattcaatacttattgtgcattctaacaataaacacctataaatggaaatgggaaaaaaaattctttcaacagagtgataaaaactatcaaatagaaactactaagaaattcatagaaattgtatcatttaaaaaactatatattttattaaatgtcatgtaaaatctgaataaatctaggacaatataaaatattaaaagggcaattccccaaaagtaatataaacataaaattaaattccatttttttataattccatttttttggatgtagttcttttgaaattggatgaaattatcttaaaactcatatggtaaaataaatgaccaaaataacaaagaaagtatgaaaaataatagttaaaaaaagaatgcctgtccaaatagcagaaaagattatacagctactgtaattacattaatcagtcatataaaaaatgaagagcaataaaaatatgtccaaatatatagaattttataaataacaaagagtgtatgtgagtaggaaaaggaaagcttgtttaattaataatcataacacaaatgaaagaaagtaaatttaaacccctattgtaacacagtattaaaaaatccagatggattacagaattgattttaaacaataaaacaataataatcttaaaataaattataggagttcattagtatagcctgggataagggagaattcttaatcaagacaagaaacctagaagaaagaaagaaaaagattgatatatttcattacataaaaattgaaggccaggtgcggcagttcacgcctgtaatcccagcactttgagaggctgaggcaagcggattacttgaggtcaggagttcaaggccaccctggccaacatggtgaaatcccatctctactaaaaatagaaaaattagctacacatggtggcacacgcttgtaatcccagctacttgggaggctaaggcgggagaattgcttgaacctgggaggtgcaggttgcagtgagcagagattgccactgcactccagcctggacaacagagagagactctgtctcaaaaataaaataataaaataaaaattgaaaagatatcacaattaatcatcagaaaaatgacaaattgagaaagaatagttgtactacatataacagattaagggttaataactgtgatctataaagtgataaaatagtataaaattgggcaatttatatgaatagcaattcagagaaaagcaaatctaaattatcaacaactatttgaaaaggagcttgaactaatagtagctgaggaagtactaattcaaataaaaatgtgatatctattttgcactatcttcactggaagaattaaaatgtagaagaataaagattatattagctatctatttctgtgtaacaaattaccccaaaacttaaaaccgcaaatgtttattatcttgcagttttcatggctgagggtctaggtatggctctgctgactcagggtctcgaaggctgcaattaacgtgtcaattgggcctatggtctcatctgaggcttgactgggagaaattgacttcaaagaccactcacatggttgttggcagcattcagctcccacaggactgttgggttgagggcctcagtttcccactggctgttaatccaaggcctccctcagttccttgtcccatgggcctctccacggaacacaaagtgctccatcaaaatgagtgaaccagacagcaggagagagctaataaaacagaagccagaggtctttgtaacctgatctcagaagtgacatgcattattctttccatattctattcattagaagcaaattactcagtccagtctatacataaagggaagagattaaacaaaggcataaataccaggaaagcggatcactggcagttatcttagaggcttcatatggcagttgtggagaaaaagactgcaggctaacattgttggtggcaatggaaactgatacagctgttttggaaagcaatggcattaagatcagtccctccgcatctcattcagaggtcactttggtttgctaggttatttcccgattttacaactgcaagcccacatcctggaaatcccttcagtcctaggcaaaccagcttggtttgtcagcctactctagagccagactgtctgggtttaaatcatggctccatacttaactagcaatgccaccttgagtaagttacttaatttctctatgtctcagcttccttatttgtaaaataagcatgataatatcatgtttgtgggaaactgagacagtacctgtaaagtgcttaaagcaatgtctggcacattaaaaattctcaatgatatccattgttactatcatagatattaaaatatatgtatcctttcactaaggtatacaaacatttatcatccaaactgggaaacttttgagagtgaaaaggagtgctagtaataattatgccaggtcataaacaggaatattccagggagacttggatgtatgattaacttacatttgacccacagggaaatttctctcatagaaataaaggcacctcagtataagggaagtacacagtgatgtttgttgcagttttgtacttagtggaaaataaaaaagtaattcaaaattaagtgaatgctcaccagtagacaaagaataaatcacaatacataatgtttttaaatattatgcaacacttaaaacaatgaaatacagtgacaccaactgacttgaagaagttctttgaaatatctttgagtaaggaaagtaatatgcacaaaagtacaaatagttccatttgtaaaacaaaaggtttacactcagaggcaaatattgcagcttaagcttcagggtccagctctttcataggcccctcccaagatgttgagaggggtctagaaatgtttcctcatggttacatgtttttgtaaattatgcaaaagtaaaatattttaattgcaataggttaatacctctgtttctttcacctttaatttccctatcatatttctctgtattttgggtagtatttgaatggctgcagacatttttggaatccagctaaaggaaagatgaatcttgggcacatttagtttgggtttagtaatatatatttatgaattctgaagtcactcccatgtacatacagttcagatgtaagaatggcttctaggaatacccctaccacctcctgtgccaactcatcgggtatgcaacagaaagttttaaagccatattttgatatgggtgtgacctatgatgttcggtaccagaaatatttgtgtagtgagtgagaaagatttgaaatgtacagaactagccagtggaaaattcttccaaatcttcaagcttggaagtgaaagaaggattttatcaaagttgacaacaatccccaaaatcagcgtgacagtaccaataaccgattgtgaagctgaaataaactttctaacaaacaatgataaaacattaattttgatcaatcatgctagaggaaagaccgaattacccttttattttctctatcagagcattcttcaacagaaatagcgtgagccacatatgtaactttaaattttctaatacccatattaaaactttttaaataggtaaaatttaatgtttatttgacccaatttacttaaaatattagtatttcaaaacaaaaattactaataaaatattttacattctttttgtgtactatgtcttcataatcagatgtgcaatttatacttttagcacatgtcaattcagacagtaaactttaattgaaaatacacaatctatatttagactttgtagaattacagttgaaaaagtggattcatataaccaagtttttctaaacataaagttttcaaataactgaattgaacaccaaaaatcattttcctttaatatttggacctatgttgataaaactggttcattacttttaaaagaattaagttgactttgaaatataaccatttcaactttaaaattatgtctgcccaagtttaagtaaattctctgactcagcaatattaatagaaaagtcaaaggggtattgcataaattttaaaacagctctaaatttatcaacattaataaagctttcttcaaatttgttttgtttttgcaatacatttccataatgctattgaccatcaatggatggatggatacagaaaatgtggcatgtatatacaatggaatactgttgagccttaataaaagaagaaaattctgccatttgtgacagtatggatgaacctgggggacattatgctaagttaaacaaaccaggcacagtaagacaaatactgcatgacctcacttgtatgtggaatctagaaaagtcaaactcatataagcagggagtagaataatggttaccagacgttggagaggtgggtggaaggagaaaggcagaatgttagtcgaaaggagaatgttagtctaagttgcagttagaggagaggattaagctttagggatctattgcacagtatggtgactatagttaatacattgtatatttcaaaattgctaaaaaatagattttaaattttaaatgttctcactacaaataaatagtaggtatgtgaggtgatggatatgttaattagtttgatttatccattccattatgtatacatatatcaaaacattacactgtatcccataaatatatacacctattatttgtcaattaaagatcaatttaaaaatgaaaaatttaaaaaaatacatagatgactaggacatagagtataccctataagagagagacataaataacatgcatgtattttaaatattcaaaaattttttcatattgattcatattaatgtgtaaaataattatattgatttgttttatgaaaagctctgtttcaacacaactctttgtgtccttctcactaataagctcttcctttccttggagcttcaaacttagcttcttcatgtgtagtgtgatatcaagaaaatgtaggcacattgccatttctttacttactaagaaaagatatttttaatatacttcaaactgtgcaataaatcaataaaggaatttttttgttttaaaagtcaaaaaatctggatttttgatctaatataacaggaataccacatgttgtgatagatactaatgttttcacatttagtagaaattatttctttgatgtaaattttaaaaatctatttcatgagtttgattatttaggctatgagttgaaaatattttttaatttagcaaatctgaaggttgagagaaagcatactcaaagtgttaattaggcagtgtctcatgtcacatgacttacctatagctaatgaaaaatatctgcaattaaacatgttcttaataagttacatatgacattatttaggaaggtttttgtattcaatgaacagttgtttggtggtttaattgaagagcttttggttgtttttggcaaaatatcttcattagttttttcctcaaattttctagcaaaattttcattactgaaattacttcttttaccagatctcacttaaaatgttcttccctttgtttggaacctaatccattttatagctggcaaaaattacaagctcaaatccttccaaaaattgtttttatattttgtgttggatatttaattttgattcaggcaaataattttcactgatttttttttttactgttaagagcaaatgtctttttttaaaaaaaaattcaatagcttttgaggtataagtggttttatgttacacgcatgaattatatagtggtgaattctgagatttttgtgcacccatcacccatgtagtctacattgtacctaatgtgtagtttgtttttttatccctagctaccctctcaccctcctgcttctgagtccattatatcactctatgatgcctttgctgacacatggcttacctcccatttataactgagaacatatggtttttggtttcacactcctgtgttacctcacttagaataatggcctctagcttcatgcaaattgatgcaaaatacattattttgttccttttaatggctgagtagtattccatggcatatatatactacattttatatactacattttctttatccactcattagttgatgtgcacttagcttgcttccacatctttgcaattgtgaattgtgctgctataaacatatgtgtgccagtatctttttcatataatgacttcttttcctttgggtagacctagtagtaggattgctgtatccattggtagatctacatttagctctttaaggaacctccatactgttttccacaaaggttgtactaatttacattctcaccagcagtgaataggtgttcccctttccccacatccacaccaacatttgttgtttgactttttagtaatggccattcttgcaggagtaaggtggtttgaatttgcatttccctgattagtgatgctgaacatttttttcatatgtttattagctatttgtatatctccttttgagaaatgtctattcatattccttgtcaagtttttgaaggaattatttgcgggttttttgttttttgttttttctgatttgagttccttgtagattctggatactagtcctttgtcggatgcacagtttgcaaatattttctcccattctgtgggttgactgtttactctgataattatttattttgctatgctaaagtgttttagtttaattaggtcccatttacttttgtttttgttgcatttgcttttggggtcttagtcatgaattctctgccttggctgatgtctacataagatttttcaacatcgtcttccagaatttttacagtttcatgtcatatatttaagtctttgatccatcttgagttgatttttatatgtggtgagagatagggaaccagtttcattcttctacatgtggcttgccagttttcccagcaccatttattaaatagggtgtccattcccaaatttatgtatttgtctgctttgtcaaaatcacttggctgtatgtatttggctttatttctgggttctctattctgttccatttgtctatgtgcctacttttataccagtatcatgctgttttggtaattatagcattgcagtataatttgaagtctggtaatgtgatgcctccagatttgttctttttgcttagggtcactttggctatttgggctccttttgtggttccatatgaattttagaatggttttttataattctgtgaaaaataatgttggtattttgatgggaattgcattgaatctatgaattgctttgggcagtatggtcatttttccatgagcatggggtgagttttcatttgtttgtgtcatctatgattactttcagcagtgttttgtagttttccttgtagagatctttcaccttcttggttaagtatgttcctaggtatttttatttttttgcagctgttgtaaaagggattgagttattgatttgattctcagtgtgatcattgttggtgtatagcagtgctatggatttgtgtacactgattttgtaacctgagaatttactgaatttgtttatcaaatccaggagtcttttggagagtttttagaatattctaaatataaaatatcatctgcaaacagcaatagtttgacttctatttgaatgccttttatttctttatcttgcttaattgctctggctaggacttccaggaatatgctgaaaaggtatggtggaagtaggcaagcttgttttgttcctgttctcggtggggggaatgctttcaactttttcccattccatatgatgttggctgtgggtaggtcatatatagcttttattattttgagataggtcccttctatgcctcatttgttgagagtttttatcacaaaagtatgctggattttgtcaaatgctttttctgcatctattgagatgatcatatcatttttgtttttaattctgttaatgtaatgtatcacacttattgacttgcatatgttaaaccatccctgcatccctgggaggaaacccacttgatcatgatgaattatctttttgatgtgctggatttggttagctagtattttgttcaggatttttgcatctacgttcatcagggtaattagtctatagttttcttttttttgttgtgtccttcctggtttgggcatcaggctgatactggcttcatagaatgatttaggaaggattccctctttcttaaccttttggaagtttcagtaggattggtaccaattctctttttaatgaatgtctggtagaattcagctgtgaatccatctggtcctgggcttttttgttgttggcaattttaaaattatggattcaatccactgcttgtttttggtgtctttatggtttctatttcttcttgatttaatctatgagtggtgtatgtttccaggaattgacccatttcctctaggttttctagttcatgtgtgtataggtgttcacagtagcatccaatgatcttttgtatttttgtggtattggttgtaatgtatccagtttcatttctaattgagcttatttgaatcttctctcttcctcacctggttaatctagctaatgatctatctattttgtttatttttcaaagaatcagctttttatttcattaatctcttatatttatttgtttgaatttcatttacttttgctttgatctttgttatcttttttcttctgctagctttgggtttagtttgttcttgtttctctagtcccttgagatacaacataaggttgttaaaatttgtgcccttccagtttttgatgtgggcattgagcactataaactttcctttagcactgctgttgctgtatcccagagaatttgataacttatttcattattatcattcaattcaaataatttttaaagttccatcttaatttcattgttagctcagatatcattgaggagcaggttatttaatttccatgcgtttttatagttttgagggttcctttttgagttgatttctggttttattttgctgtggtttgagaagacacttatgatttcgatttttaaaaatttattgaggcttcttttctggcctgtcatatggtctatcttgaagaatgttacgtgctgatgagaagaatgtatattctattgttctagggtaaaatgttctgtaaatatctgctaagtacatttgttgtattatgccatttaagtccaccgtttctttgttgattttacgtctcaaagatctgtctagtggtgtcagtggtaaattaaaatcttccactattgttatgttgctatctcattttttaggtctagtagtaatgtttcataaatctgggagctccagtgttaggtgtatatatatttaggatggtaatatctttttgctgggttgacccttttatcattatatagtgaccgtctttgtgtgtgtgtgtgtgtttttttttttttttttttaccattggtgctttgaagtcagttttgtttgatataagactagctactcctgcttgcttttgtttccgtttgtgtggaatatctttttccacccttttgccctcagtttatatgaatccttccacaaggattcatataatgaatctcctgaagacagccaatatttggattgtgatattttaaaatccattctgccattctgtaccttttaagtggagcatttaggccatttacattcaacgttaatattgagatgtgagattctgttctcttcatcatagtaatttttacttagtttttttcattatgtcattgttttataggccttgtgagttttaagctttccaaaggttcgattttgatacatattgggcttttcttcaacgtttagaacaccttttagcacttcttgtagtgctggtttggtaatgacaaattccctcaagatctgtctgaaaatcactttatttcttcttcatttgtgaaacttagttttgtgggatataaaattcttggctgacagttgttctgtttaagaaggttgaagataggaccccacacctctctggcttgtcaggtttctgctgttagtctgataggttttcctttgtacgttacctgatgtttttgtcttactgctcttggaattctttgcttcatgtttactttagataacctgatgactatatgccttggtaaatatctttttgcaataaatttaccaagagttatttgagcttcttgaatttgatatctagatctctagctagaccagggaagttttcctcaattattccctcaaataagttttcctcaattattccctcaaataagttttccagacttaatattttctcttctctctcagaaatgccaattattcttaggtttggtcattttccataatcccatatttcttgaagactgtattcatttcttttgattcttttttctttattttgtctgactgggttaattcaaaggccctgtctttgagctctggaattctttcttctatttgttctagtctattgttaaaactttccactgcattttgtaacgccctaagtgtatctttcatttccagaagttcggattgctttttctggatgatatctatctctctagaaaatgtttcagtcatatcctgaactgctttaatttctctatgagggttttcatcattctctaatatctccctgagtagcttaataatcaaccttctgaattacttatgtggcatttcaaagatttcatcttggtttggatccattgctggagagctagtgtgatctttcagagatgttatagaatcctgttttgtcatattaccagagttacctttctgattccttctcatttgggtagactattccttctaattattcttaaatttatgtttgatttgactgtgtttttttttaatattccttttttcccctaaaagatgtgactttaatgcttatagttaattattgcctaacttagttcttggtactttcaggggtgaagactctgtaagatttccttggttatagtctttgcatgatggctttctcatatgctggttatattaagaacgttctcagtgtgtgagcaagttcactgtttactatggggttggaatggcagaggtctcttgatgcttatctcattcttccatggcatgtgcttatttatttatttatttatttatttatttatttatttatttttccccagtattttatttgctggtttgatggttcaggcttcaggccaataggggaggtgtcccttgacaggaaccagctgtggctaaagcaagtaggtaaatgcaatacccaatggtgggtagaggtcccagccttgacagaggtggctggaggagctcacagtgatttgcactaaggtcttatcaaggggaagagttgcagttacctcagctcccctgtcaggtcagcaggaaagttatccacctctcagacacactcctgtcctagtgctctggctatgcagatcggataggcacctcttttcatctgtaggaatgttgatactccatgtagaaagcaagtgactctgtgtcttatgcaaccctgaccctgtagggtgctcctcctgtggggatgcagtaaccctgacatgtttcagaaaggctgtctattgttgtacccatgctgagttcccatgggagaagccccaactgtgcctgccatggtggacaaggggggaatgacatctccttctccaaggcctatcaaatgcaccagggctgattgttgggttagagctgaagaatttccctgctgaacccagcactggaactgtgcttctgctgaaggaaacttcatatcagcagaaagatctggtgctcaaggcctgccatccaggtccttctgaaccacagggtattcccttgatttggtacactcccccttctcctaggaggtgggaatcctggaagctagactattatgaatgttgttgaagagtgaatttcttatcaaatttactatgtatttgtgaaatatacctcttactatttcccacttaattatctttaaagttttgttagacaacaaacagctgtttcagtttcctctgcattggcaaattacaattaccatcatcatgacatagacatgcttttctatgtttgtatattaaaggatatatactgagctttgagcattgcttaaaatgaaggtgagctgaagagtgggaacaattgggtcaggcaaaatgtgagacttgattagcattgcctatataaagttaggcattgtttacaggttttaattcagtgctacaagcatgtatgtctttagtaatttataagacattcaatatgggggggggacatttttcaaatataatgtgatttatattttttattgttgattcatatttcattatattatgatttcagattgtgacttatttctctgatgtgttgaaattgccacaatgacctaataagtggtcaatttttctcagggttttatgtgtgcttgaaaagaatatatatattctgtattgatgggcacaaagtcctagatatgtctattaaatcaagcttattaattctattattcaatagttctaatattatatttcttcatttgtcaatattctgaatgaaacatgacatattaaaatcttgcaaatattgtagatttctgtttctcaaaatcctatcagttttggcttttaatgtttcaaggctgtgttgtgtattgttgtatgtaaaaaaaattacggctatgatatcttcttggtattgtgctttctgtggtttgattcttttaatattataaagtattcctctttatcctttttaatgtttttagccttcaattaaattttgactaatgatagtcctgcaatgcctttctttatgttggttttgcttgatctttcctattttaacccaattctttcaaactttctgtgtcactttgatttaggttttactcttataaaaaagcatatagcaagaattttaaaaattgcatgcaatataatctctttgtctttcattagttatcttctccttcgcatttttggtttgccatgtttcttctttgcttcactcttttttccaagaactagggacattttaattaataaattgttgctttattcttttagtcttcattattggtttcgaagatatattttcctaatttttagtggtttctcttaaaatttttaccagaaatgttttttaacaaaaataaaaattattaagtacctttgtttctctagttctttagcaaacctctatcttgcttgtttttattgtctggaaatttaatatgcccagctgctcattctcagcagaggggcagactttctggccctagctccagtgaagctcttttagactccattaccattaagaatgcaatctccccactgctctgcccactgctggaccaagtcacgagctgggctgctattcaagtcccactttctattttgtgcttctgatccagttgagcatcaagatattttctttgcttttcagcacaagtaacgtttataattttctgtttttctattttttctttcattattgtttggaacactgggcaggagaaaataggggaaggattgctttaacaaaaacttgacagatcttgccatgatgacagagccattatacttctataataagaaaaatgtttaaattaattaaaaaatgaatacagtacaaacgcaatcccagaactttgggaggcgaggtgggcaaatcataacatcaggagtttgagaccagtctgaccaacatggtgaaaccccaactctactaaaaatacaaaaattagctaggcatggtggcacgcacctataatcccagctactcaggaggctgaggcaggagaatcacttgaacccgggaggcggaggtggcagtgagcggagatgacgccattgcactccagcctgggtgatagagcaagactccatctcagaaaaaaaaaaaaaaaaaagtacccacaaatgtatatacaccaaatgttcacattgatataaaaactatgcacagcaaagaaagaaaatacatcagaatattaaattagttgctgcaataagtatgatacggggaaagtacttttattctttttactttctatatattgaacaaaatttagtaaaactttattctattttataatgagaatacatatttttgagctactagaagagaaaagaagcattatattagtagctatgctaaaaattttaaagtaatacaatccaacagcaattaaaaggtaggcattttaagtcagctcataccttcagaaaggtatgccaccgtatctcaagatttacacaaatcacttttacacacgtggttatagtaaccaaagtatgcttcagttgaaatgataatccagcatcctcatagatgcctgtgactaaaggtcagttagtttcaaaaggaatggagtgcttagctgattcaatgctctcgacttgtttacggcatagcttttagcattccattattctctttttattgcctttatgcacaggtgaaaaacacagaaaacactagatgattatttggtaataaattgaatggttctatggaaatgaaaagcatagaaaacctatgtgattaaatggcaactgcagtttttctctggattctgcatataaatagaataggttctcccacagagaatgagcctggctaaatctgatagttaaatatacagctctggatgtaataatagtctttgaaccttcttgaatcccagtatctagagtgctttaagctattattttgccaagtactgtagataaagcctctctgttaccctatgtttaatatgtctttgttgtctttgtgtcttacacacctagttgacctggaaaatagtatgtcctcaacaaacgtttgtggaacaaatgaattggtggatagatggattaatgaatgaatgattttatgaaaagagatggttctgaacagtaaaaggaaacactgaattatttgaataatgcactgagaactacagtgatttctcaatgccagatttgcttctgaattcttatctccttcaacaaactattcccctattctgttttagtttccacaactgcaatatgacatctgatgataaatgtgatgaaatcacagatctggatatattttgtacattatttattgactgagattaaataacaaaattatttttaattctctatttttctaaattattcaaacctcatctgttaatacccaaaaataacacctaagaataacctagttttctcttttccctttttgtataaattgcctctgaaaggccaattgaagaactattatgagcttcttgaatttgtgtgttctaatataaacataaaatgtaatctattagataaaatctagaatacaatataatcaaggtaaaattgttactttttaaacatacagtgtgactgtattgtatgtcagttagttgtgttaatgttacttagagtctaggactatgtaaagacagaactagtagtcttcatataatactaaatgaaaagaaaatgaattagtaagtctgcagtagatatatctgacaagtctagaaaatgcaggtaaggtgaatagttaaatatgagactacaagcattacgtaagattgtaagatttctacaagattatattttcagtataaaactatttcccaattaatgttgtatgcagcagctgctaaatagagcaaagttactgagtgattccatgaagtaagagcttaaggctgggcgtagtggctcacgcctgtaaacccagcactttgggaggccgaggcaggcggatcatgagatcaggagatggagaccatagtgaaaccccatctctattaaaaatacaaaaaattagctgggcgcagtggtgggtgcctgtagtcccagctactggggaggctgaagcaggagaatggcgtgaacctgggaggcggagcttgcagtgagctgacataacgccactgcactccagcctgggcgacagagcaaggctccatctcagaaaaaaaaaaaagcttaattgttagtatgtgctgaaattacacaattgtgagttccaagagctataatgatattgcctcttttttaatttttattttagtttcaaggctacattttcagatttgttatataggtaaactcgtgtcacaagggtttgttgtacagattttttaatcactcaagtactaaacctagtatccaatacttatttattctgatcctcaccctcttcccaccctccacccacaagtaggccccagggtctgttgttcccttcctggtgtccatcatttagcacccaattttaagtgagaacttctcacttaaatgatgatgagcacttctcatcatttagcacccaattttaagtgagaacatgcagtatttggttttctgttcctgtgttagtttgctaaggattacagcctctagctccaaggctcaaaaaataaactcaaaatcatgcaattacatggaaattaaacaacctgctcctgaacgacttttgggtaactaataaaattaaggcagaaatcaagatgttctttgaaactaatgagagcaaagatacaacataccagaatctctggaacacagctaaggcagtgttaagagggaaatttatagcattaaatgcccacatcaaaaatttagaaagatctcaaattaacaacctaacatcacaactaaaagaactagagaaccaagggcacccccaaagctagcagaagacaagaaataactgaaatcagagctgaaatgaaggatatcaagacatgaaaaaccgttcaaaagagcaacaaatccaggagctgatttgttaaaaaaattaataagataggccactagttaaactaataaagaagaaaagagagaaggtctaaataaacacaatcagacatgacaaagaggatgttaccactgaccccacagaaatgcaaataaccatgagaggcaactatgaacatctctatgcacataaacgagaaaacctagaagagatggatgaatttctggacacatacactcttccaagactaacccaggaaggaactgattccctaaacagcccaataacaagctccaaaattgaattaggaataaatagcctaacaaccaaaaaaagcctatgactagactgattcacagccaatttctacccaatatacaaagaagagctggtaccatttctactgaaactatttcaaaaaattgataagggactccttgcgacctcatcctatgaggccagcatcatcctgatactaaaacctgccagaagcacaataaaaacaagaaacttcaggccaatatacttgattaacattgatgcaaaaatcctcaacaaaatacttgcaaacttaatccagtaacagaccaaaaagctaatccaccacaatcaattaagcttcatccctgggatgcaaggtaggttcaacatacacaaatcaataaatgtgattcatcacataaacagaactaaagacaaaaaacacatgattatctcaatagatgcagaaaaggctttcaataaaattcaacataaaacctctcaataaactaggtattgaaggcacagacctcaaaataataagagccatatatgacaaacccacagccaacatcatactgaatgagcaaaagctggaagcattccccttgaaaactggcacaagataggatgccttctctcaccactcctatttcacgtagtattggaagtcctggccagatcaatcaagcgagagacagaaataaagggcatccaaacagaaatagaggaagtcacactatccctgtttgcagacaatattgcctctttcaggagcattgaaaataactcttgtcagggtttcaactgcacactagccaggataatctaaatttaaatattacaatgtataagcaaaaatagtagttaaaaatctgtatctttagcagatgcaaggttattgcagaagtttaaggagggtgatgcaatcagatttgtggttttaagattactttgactgcaatgtgaataataaattcacatttctacaaagaagatacaatctacagaatctctgggacacacctagggaagtgttacaagggaaacaggactttaggaaactattataatagtccaaggaagtgttacaagggaaacaggactttaggagactattataatagtccaggacagttattggtggtgacggagattaagagaggcagatggatttgagagatatttagggatagaaatgtacataattaccctcatcctactgtttattccagctaaaagtcacaagacctggcgcttatttgaatatgaggaattgatagggaggttgcaataatgaccttcaggctggatgaataattaaatcatttactgagatgagaaattcagcatgaagaaaaggtttggggggaaagatgtgggagtttagttctagatatgctaaggttgaggtgcccttggagatatataagtaaataagtagatgatattaagtagatatacaagtaaagatattagatggattaatagatgggcctggagttaagagaagtggtctagcctggagataagtatgtcggagtcttcagcatgttgattgtaacagaagccgtactatagatgagataatttatagagagaaaaaagtaaaaagaataaagaggactgtttacgagccttgaggaactctcaacttttagagtcatgcagaaaaatgtcagccatcacaatagagaaggagcaccataataagatgaaaatctaccttagacgacaaagggaagaaagggtctccagatggaggtgtcgccaacctgtgcttctgagaggttaagaaaaagtgaggatcgagaaatgccctttttgattttgtgacatcaaggtcattagtaactttagaaagcacatttccacagagtaatggggaatagacacctgactaaagtgggctgagaagtgaaaacaaagaaggaaaatgaacatattgagagcacgggaataaagagagaacactagctgagtcgtcaggtgggatcaaggaagttttcatttattgtttagttgtttttgctgttagttgttcttgtggtttgctactgcttttcaaacgataaagacccgagcagatttaattgttgatgtgcacaatgcagtaaaaaaggacaattcactttgggaggccgaggtgggcgggttacgaggtcaggagattgagaccatcctggctaacacggagaaaccccatctctactaaaaatacaaaaaattagccgggcgtggtggcgggcgcctgtagtcccagctactcgggaggctgaggcaggaggatggggtgaacctgggaggcggagcttgtagtgagccgagatcgtgcccctgcactccagcctaggtgacagagggacactctgtctcaaaaaaaaaaaaaaaaaaaaaaaggacaattaaaattatagaggagagaaagactgaatgcaggggtcaaattcctgaggaggaaaagacctggcgcatagaagatggagccaaccttgggcaggaggaggaaaaccccctgtatcttaacaggagcagggagcaagaggaaggttacagggcagttgcatttaatcacctaatgaaggaagttaacaaagttccatctggtaaattctattttctttatgaattaaaatatgagaccatctgctgagagtgagagacaagggaggaaaagtatctcaggattgaggaaagcaatacagaacaagagtggaatgtgaagcagtgtggtaagtccactctactttcatgagcatgaacttatgaattaatgaatgtttaccttgttattatacatacactgacattataggagaaattctgttgcataggatagcatacacgacatcataaagagcctatattcccacatcatcaaatcatcaacctagcaggagttcattgtatttttagaaatcttactagtctacaattcatgttattcacacacagtggaaacaaaattgatttcaggggagaaaaagtgtgtgtgtgtgtgtgtgtgtgtgtgtgtgtgtgtgtagtttataatattgttttccaactacaacacatttccactaagttgaacaaattgagatgattatattttttaattggtaaactgtccatatggatgaaggaggcaggtaattcccttcaggtactgctttccttgatttctctctttgcccatccatgaactagcactggtttacaaatttatcatgtagatatctgctttaataaatggctaagacagcactgagcacagagcaaatgccaagtaaataattactgtttgataaaagtgcttcttatcagcaaggccagtatttgtgtgtaaaataatgcttccatggggctcaaaaatagtttgctctcttaaatgagttaaatatacccacagaaatcatgttgacactacccacttgctcagcagagataaacatttgttctagtccagtctgaattcatttaatttcaaaattttggcaatagaattaaggaagtttcaccattcaaaaaatatttaggtataaacaagttacagaatcaccctcacactcctacctatttcagatgttgcagaaggtatagtagagtgtggattattcaccagatggcattttcatttcaggttgaccacagtccagtaagcacattagcaaattgaacagaggtaactaagacccacactatcttggcatgcagctgctgaatgtgtcctttttttatcagagatcatctattctctttcaacatgattggaagcagtctttgctggtggttttgtaaattgctcattaatcaaaatggatttatcgggcatccatagtatacaaagcctgtactaagtgattcaaaataacggttgcctagttaccttaaaatggaaaaattcccctaggaaggttaaaatcaaaggaaaaggagacaagaaaacattatatttgatgacacctggctatttcataagggattttactgccattacagccattttcttttaaacataatatccatccattcattcgttcattcaattattcattcatttatgcaagtgagtcaccactataattaaacaaggtctttagcttgatgctataaaggaaacaaacaggattcaatagtggtcgcataaacatgagtcttagcaaattcaccaagcaagtgctagactactgttggtctttatttaataagtccagtactagaacaatcttattctttacttcatgtgaaatctgtagtcatgaggcattagtaaaatgctccttggaaagagtatccttcattttctggttgaattgtaaaatcttgctgaatacagatctactaataagttgcttttatttaaattaaactagtacatctgataattttttttttcctgtggtcaggattagatttattttgtactagcccttctagtttttaatacaagagaccacagaaaggaaagttaactttgattttctgagcaaatgcatacttataccatgaatacacaatgttgccagtcacaaccaaccctcagctgctcagcccctgagaaatgaaagccaggcaggttgtgtgctgtactgtggcccaagcatcctcaattgcctctccctattatgtattgaatttgtgtgctcagttttaatccctatatttgttacctaggggtgcttcaacaaactacagccatccctcagtgtccaaggggaattggttcccagactccctgttgaggaggattgggtatttgaggatacccaaatctacggatgcttaagtctcttctataaaatggtgtagtgtttacatataacctattcacatcctcctggatactttagatcatctttagattacttgtaatacctactgctacataaatagttgttatacagtattttctttagacaatgatgacaagaaaacaagtctgtacatgttcagcacagacccacccatccatttttgcttctgacatatttttaatttgtagttggttgaatccatggatgtggaactcacagatacagagggccaactatactagtaactgggtggcttaaacaatagaaatgtattgtgtcacagctttcaaggatagaagtccaaactcaaggtggcagggatggttccttctgtgggctgtgagggaaggatctgtcccaggcctccttggtttgcgaatggctgccttttcctgttatatcttcacattgtcttccctctatgggtgcctgtctctgggtctaaatttcccttaaataaggatactggtcatattggattagggtccacttaatggctttattttaacttgattatctttacaatgattctatatccaaattccccaaataagatcatattctaaagtactataggttaggattccaacctttcttttcgggggcataatatgggggggacacaattcaatctataacagtccctcttaagacttgatcacccctcagtctttctctttctctctctctctctctccacccccacctccaccaccctgtctctccaggaaatcttcatgcagttcttgtatagagtagtaatgcccattttgtctgtaagcctaagccatgttacctaacacagttaacctaaagcattgaatgcattccctgaagtacaattctcaaatttccttgaccccttattgtccaagtgtcagcattctcaagatgagaaggatgagctttactcctacatgcttctcagctttgtttccccttgcctttctctgctgcaattgtctttgttctggccactgtcatttcttgctgagtgtatgcactgatttgctaatgaatcttcccgctttcaacttcatctttctccaatctatactctatactccacattgcttctagagggatcattctaaaacagaaacctgatcatgccatgttcacttctgctgtcagatgaaatccaaacttctgcctgttactccttgttctttatgcattctaccctagtatcattctatgctctaaccatgccaagtgggcatagtctctgaatgtactctgttctttcaccctctctgcatctctgcacacactgccccttgcctggagtgccataccttattcatctatctaactcctccttctttgaggctagcaaatcatgtagcacttcctcccacaagccttccttcattcacattcctccccttctactctcccagagcaccctatgcttatcttgttcattgcccttattatccttaattttaacacattctaagctcctaaaggtcaacacttataccttttgctctgttccttatgcaatatttagcacaatgcctagaacatcagaggtactcaataagtgcttattgaatggatcagaactatagggtatttacccaccaagatcaatttgagggtctctaaaagactcgtgtgcatcaagaaatgtctccacgtttgcaaattctacctttactcactaaagaatttagtaacaaagggaatacatcagtaactccaagagaggtcagtaacttccctgagttctccagatcagttagttggccctaagggggaaatgcatagctaggtatgagtcacaagggactagtcatagcagttgagagacttggaagtaataggattgatgcaaaacctaaactatgggttaatggaatcaacagaggaaaaaatgcaaactatttccttacctaaccagaaaagaagtaacagttatgttgatgctctcctctacctgctatggcgcttattgggggcaattctgtggggctgagtggataaggtctcatataaaattacatagaaactgttttgatctatattcatcccaattctaatcattttttaaaaaccacaaaatttccctttaaattctggactcctttaccttagaattcatgatcacagcccaaagactatcaattattatgaattaagcctgggtcaactgagcaaactggcttcttctatactaaacccaagtgatcaaacacaattggggaaaattatgtagccatgcaaactaagtctttacccaattttaacaacaacaacaacaaactcaggcattgtaggagtttatattttctgaaagtggctgcaagaatatcttcttataatgtgactttagttaacactccttcatcaaggggaggcaagaattaaattccctccacttaaatgtaggcaggcttttgactacaatggaagtgatgttgccttctgatgtctcattttcttagaatgtttgcttagaatcccaacacagaccacgagaaagtccaagtaggccatggcagcgatatgagtatggatcttgagaataaaacctccagaccccagttaagcttcccccgttgacaccacatggaacagagacaagctatccctgccaagccctccccaaattgcagatttaaaagcaaaacaaatgactgttgttttcactcactaagctttggagtggtttgttatgcagtgacaataaccagaagagattttgatagttggatatggggtgctgccaaaacaaaaacttaaaatacgtggcattagcaccgagattgggcagcagacagaagctggaagagccccaaagccagtgcctgtcaagccaaaagggccaaggaaggatggatttgtggaagccttaaaagctataagaaaggtgttgatgaaagcttaaaggaaagaaaacgtaactgtaagctgaaagaaagtttcttctctctctgcagtgttttacctagacctgtggcaaaaatctaagactcactccctctctctgtgcatgtacaaagaagaggtttggtaagcagggtgatgacagccttcaacaagccaggaagagagctctcaccagaacctgaccatgccagtaccctgcagatttccagcctccagaacaaggacgtaatacaaatgatgcagcttcctcttagttctttggggatgcttgctctcagaatccaggcagtagtcaggaggaaacccaagcagtgcctggagagcaaaaaaggcctccagtccattgccttagccaagttactggtacatagccaacactaactttcagccatatgagctggccatcttaaaagtgttcctctattccccagttgaacagcccgagatcataagatgtgacacagataatcagtccctgacaagccctgtcaaacttgcagatttgtgagcaaaataaatgactgatgtcagtttgttttggggtggcctgttaataacaatagataactgatacaggcatcatctcctttatgtcttcctcaagctccaggtaaggttaagtactcccccatttttgctcccaaagaactctttgtgaaacactatcttagcaattattgtgctctgttgaatttaactcttcacttgtctacctcttcgagctcaagggtaatatcatgctttttgaaaaattacctcctcaaatatattatatttgtcacattctctctttcttctcctctggaactttgattagacgagaaaactttgcagtatatctttcaagtctctcagcttctctttcatattttccacatttttgtctctgtgcaacattctgaaaaatttcttgtggcttaatttccagttcactatatctcccttcagctgaatctcatctgctgttccactcattcattgagttttaaattgcatgtgtgtatgtgtaagtaattggaatttttttcatttctaaaagttttttttttcctctccaatatgctaggtcattttcttttagtttctattcccaaaaaatatcttcaggctcactttttctttataatggcacagtcattgtatagtctacatctactaattccagtatttgaaagcacttaaggtgtggatcggctcttccttgtttttgttggttcctgttgggttttctttccctataggcttaattattagaaactgttaattttaataataggaaaattattcatagaaattatttggggccctggaggagagtatatttctctccagagggattacatttgcttccacttgatacctgagggtattagtttaaatgcatgaactgacattttttggaccaccaaggtgatatgaattttgtgtggcaatctgtgagggctagttagtagtaataattcttcaggaatttcccaccccctgacctgccttgttctgctcacaaaaaatcatctttccttggagtccccttggggtggggaatacaggattacctctgattcctctaaggctgtagcccttggaatcctagttctatggaggaaggatttcctattacagtccctgagctggacaggctgtgtagatatttgttttcagtatccaaagccacagaagtcttgagcactgaagttcattagcaggttcagtaagctcccccaggacaaatgtgactttagtgcagcatttatttcctaccctcgccaatgttttggcttgattatttcttactaaccaactaataaaaagaaattcctaatttagatgtgattcgatttctgtaattttcatatcagctttttgatacttttaagaagtttttttcttttctatatcgtatccagcatttttatttgttttcagcaagagttgacctgagcctgatcagccttgttatctgtgtccatgtcattttcatccttgtatcctcagcattcaaaattgtgccccagcatgcataagaactcaattagtttttgactacttaatcaatacatagctgtgtcttcaattttgcattccttcctctatcacacctgatattcccctaccctctgtgccccaattaaagctctttcacattttgcatatctatttcctgcattttcctattttaatgaagcttccccccctgaatatgctatttccctcattatctctcttacggaaaaggaaaagttctcattcttgtcaacttccatagcctggggtcagcattgttttcattctccatgaccgctgtgggtcactttctattatttggccttcatccaaactctgatgctcatctgaagtttacactattctattataacattctttttgtaattttattgttatcatatgtggacctccagtcatatctctacatttcttgagggtttcagtatttgattcctaatatctaccccacctcatcccctagtaaaatgcagcactacagcatagtgtttaagagcacaagttagacaactcaaggtcaagtaccaaatctacccctcattaacatgtaaccttgggaggccagctaatgtttcaatgcctcagtttccttatctctaaaatgagaataatgatattaatacctcacagcattgtaagaatcatatggaataatgcatataaagcacttagaacagtatctgccacataataaatgctcaataaatttactattttcattactgcactattaccttaaaagtcttccttctgtatgtttatgattcattaacaccctagcctcagtactgctcaaaaatccatttttttcacttgtacaaaattccctagactattacgtataatggcttttctgaattttatttacttatttatttagagacagggtatcactgtgtcacccaggctgcagtgcagtggtgtgaccacggtttactgtagccttgacctcccaaactcaggcaatcctcccacctcagcctcctgaatagctgggactacaggcatgggccatcacgtccagctaattttttaattgtttgtagcaatggggtttcaccaggttgcccaggctagttttgaactcctgagctcaagtgatccacccaccttgtctaggattacaggcatgaggtagtgtctgtaataggctagtgctaagaatataggcatgagccatcgctcctggactgaattttaatttaacccttcttaagatctagctcttactttcggccaataaccttttatcttacccagaaattgaatccatttgaaaataaatatttcagaatttctctatattcataaccatgctgtcttctcgctactctgtggggaagcaaggtctgtgtttccctaaactagctgagtcttaacttctacccattctgttctttttattctttatcttcaataccttgctctaccagaaaattcctctaaacttgatcaagtcttatttatcctaacataaaccagctatttccctcttgcacctgctttcttcttatgttactatcatacctcttcttctaatctccttgaaagagtcatccgtactctctactccatttcccagtgtcttatttcccatttcccaatgtctcactattaacttccagacatctacttgtaccacatcacttctaaaatttactattcaaaagtaagttgcgactgcattaccaaaccaaaaaaaaaagcctctcttcagaatttttcttacaactccttcacagcattaaatatattgaccatccacttgaaaatttcctccttcattagctttcatataatcactctgtattctttcttaaagtaatagaaagaaactataatggtagtcaaaaatccatgttcaagcataggccccactattgctcttaaaactctaatttctttatcagcaaaatagggataatatttgtcttgctttgttcactagtttgtaatgcaaaaaataaaacaaaataatgaatctgataatgccataaaagacatgaaatatataaagcagctaagtaagatttgataacttggtaacagataggctacagaaaatgatacaaaaattgctaccaattggctgtgaactcctgaaggaaccaaagctgtgtatcttacctagaaggttttttcagtattaaaaggtttcaaagcatcttcatcaaagcattaccatgtccattatggcttttaccaggaagttaggagacttcaaataaaaaaccttctgacctacctggactcacttcaaaatgaaaaaataattattggaactacattgggggaactttcattttgataacatagtaggaaaccaaaatgttaatgatgcatcttcatatgaataagcaagtaaattgaatcaggccaattgtgagtaagagatattaccagttcttggggaaggtgcccttgcaatttctaaggagcaaggtttctttgtaacagctgtgtccatgagatcacacagaaagttctcattttctgaaggaaatgtatccagagaagcagatggtacaatttccatagtgtaatttctcttctttggataggactcctgaaaagaagaaaaaataaaaacagctttgtgatgaagaaacagccttgtttaatttataaaaactagaaaagataatcaggttcattagttctttccaaagtgattgacagctgatgattcatctgtttgaataaattatagaatcatgtaaacccaatatcagtgatatttttaagagtcctcataatttaaaaggactgaatttattactgaattagtaaaggtattgcccttttttgtaatatatatctattatctagttgtggcataaactgctggttaactaatcaacagtcatccccaagactctactcctttgccggcctcctggagacacccatataactcggagacacccatataactcaactttggcccattagatgtaagatgaagtttgctaaaaggctggtgggaaaaaatttttccccaaggaagaagcatataaggaggctctttcagagccaaggccatccccaggctcctctctttggatgcagttttgatatctggagctagggcaagcattttgtgaccaaaaggcaagaatcttcagatcaaaaaggtaacaagccaagaatggcaacagaaggataaaaagagcctgggacattgatcatatcattgagctgctcaaatagacccagggccagtttctccagtcttcttacataaataataacattcttacagtttgagccattgctaattgggttttctgtcatttagagttaaatgtcttgccatccagcacactagtatctttccttgtaaataccattaactaatatactaaggtactcttttcaggttaggataaaatataggtccagttctatatgattgattctttgatatattctaaaaattagaatttatttcattttataagattttgatttcctgtacataaggcattaattggtcaacaaatacttattgggcatctactatatatatgtagaatatatatagcatatttatatattatatatatatgtatatatatataatgtgctaaatgctggactgtttttaaactaatgagacataatccttgctctgaagaagttcacagtctgctggagaagactgtgaaattctgcatgatgaaattcacaattaatcatattttatttttgctacagatcctcctcagctttacaaaaaaacccaaagtaagttgaaaatattgtaagtagaaactgcatttaatacacttaacctaccaaacagcatagcttagcctagcctaccttaaatgtgctcagaacacttacattagcgtatagttgggcaaaatcatctggtaacacagtacattgtagaatattagttacttacccttgtggttttgtggctgactgggagttgtggcttgctaccactgctcagcatcatgagagagttatctatcatagggtatattgctagcccaggaaaatattcaaaatctgatgtacggtttctactgaacatacactgctttcacaccattgcaaagtcaaaaactcgtaagttgaaccatcatgagttgcagaccatctgtatgtgctacttttataaagtatgcctcacaatcaagaaaaagacaaataagaaaatagactaatatttttgaaaaatctccctaagtatattctagggctgataaagatttagtacgaattcctagtttttctacagtacagcagaattcaaggtcagggtaattgctttcagacaataccagaccctcacacatcagagagtcaattatggtcatgatactccattgaaagcaggaaattgggagtaatttatttttaacaacaaagggtgacaaagtagaaggcatccagaggaaagtaatcaggatggcatataattctgaaaccatgtcagagaagaaatgatgaaaggaactgcagtgttctatccagagaagccttatagccacataatagttttctcaatgatttgaaaggctatccctcatcaactatcccacaaaggggggatggagaaaagttgatgtggtagatttattctaaggcccataaagacaagacaaagactaatgtttataagtcaagaagggcaaatttggctcaatacaaaaaataattttctatgaattaatgatattgtttaccttttaaaataaaaaggcactataaaatgagttaacaaatagcattataaagcaacagaaggaagtcctcattactgaaaatcttccagcagaattatctgctgataaaattgtggatgaaacacattgtacaatgagtccaacaggttactataagctccatgaaggctggaatttgtcttgtccactactctgtccctagaatctaatacaggtcctgccaatagttgatgagttgatgctcaataaatatgtattgatcaactgaacagtctctagtgtcctttaaacaaagctaactacaagttatggaaatgattttttttcaaatgtaaattattttgcctttcagttcagttaatattgttcaccagtttgcatataaaaagtgaaaaactgagattacaacgataagattgtaaagattctatggaaaaaaagagtctccagttaaactcctagttccatcctgaaattaaattaatcaaaacaacccatggatttagttaagttggaattttacagtgtgtatgaacacttctgaggatttttaaagcctcgaaaaccactttgaaatttaatcacaaagcatgggttaatttgctttcttccttaaaaatgaagtatataggtttattagagaataatttgaaaacataaagaaagaggaaaataatcacatgaaaatcaagcatgctgagataactgagggtaatattttggtgaccatcctcccagactgtttcactctgtgaatgtgtgtggacatgtgagtatgtgcaaaggaaagaaaaaatattttaaacaataatgaagtactccctcttctgcttcctaatggagggccataatttcttcttagaatgtaagtctttgtagaacctggcttccttagggaaggtgaggcccccgcgggaaggagttggtaaaaacgaagatagtgaaacaatgcttttgtaaccaaatatttcaatgtcaagaaagagagatagttgaacaaaatatctgacaagtgaccgtcaaaagaggatatgcaagataatttttttaaaaaaatggatccatgtgtccactactcagtttaagaggtagaatattaccattgtatcattgaaacctgtcccccaacccaccccatgttcatctttccaattttaccctttttcctcctctaccagggctaaatgctttctgagctttgtgtttttaattgcttggactgtgttaaattttaactatacatgtaagtatcaataaaaaataaatttttagtactgtatgctttcaaactttatatatatagtatcaaatgctctagttcttctgtgatttttctcaatcaagattatgtttctgaatttcatctattttcagtgtggtacaggagctcattgtttaagattaccacaattcatttacacattctcctgacaatggacttttaaatgtttcctaggtgttttgttatttaggataatgttattataaattttcccatatgaagtctcttggagcaagtaaccagggttatgctgcctattctagtagtgatggggaagagtcaagaacagacagcagacgagaaaaataaatgaaatcaagagatgataatgagaatggaaattgtatgccctgtagattctatagaatcttaaggatagcatttgcagttttctacccaaagtggcaggagggttcaaaggatattctgtaaatcttattaaaatattatatataagtatagtattatataaaatatttcctaatctgttatttacctctaatgatatattttatacccttttcaatgacaattatatgtctacatgatgaacttgggtcccaatatatacctggtcataatttatttggccaatcctatcatattgaaattttaatgttttgctttgaaggaaacatttttgttcatatattttgtttacatattcaactattttgaaatagaattcctgtgataatacatatatgacttatgtttacatataattgaatctgtatctggactttctaattggttccatatatatgtctattctagtacaggcatacctcaaggtgtatcgtgttttacagatattgcatttttaaaaaaataaagatttatggcaaccgggcattgagcaagtctatcagcaccatttttccaacatgttcttattttgtgtcacattttggtaattctcctaatatgtcaaatttttcattattattatatctgttatggccatctgtgatcagtgagctttgatgttactgttgtaattgttttggaatgccacaagccacaatcatataaaacagtgaacttaatgcataagtgtagtatgtgttctgactgctccaccgaccagccattcccctgtctcatcttctccttgggcctccctatttcctgagacacaacaatattgaaattaggccaattagtaacccttcaatggcctctaagagttcaaattcaagaagagtcacatgtctctcactttaaataaaaagctaacaatgattaaggttagtgaagaagacatgtcaaaaagctaggcctcttgtgccaaacagctaccaagctgtgaatgcaaaggaaaagttcttgaaggaaattaaaagtgctactccagtgaacacacaaatgataagaaagggaaacagtcttattgctgatatggagaaagtttcagtggtctggatagaagatcacaccagccacaacattcacacaagccaaatcctaatccagagcaagactctaattctctttaattcaatgaaggctgccagaggtgaagaagctgcagaagtttgaagctggctgtggttagttcataaggcttaaggaaagaaactatctccataacataaaagtgcaaggtgaagcatcaaatgctaatggagaagctgcaacaagttatccagaagatcccgctaagacaattgatgaaggtgactacactaaacaatagatttgcaatgtagatgaaacagcctcataccagaagatgtcatttaggactttcacagctagagaagagaagtcaatgcttggcttcaaactttaaaaggacagtccaactcttttgttaggggctagtgcagttgatgactttaagttgaagccaatgctcatttaccactccaaaaatcctagattccttaaaaatgatgctaaatcaacttttcctatgctctataaatgaaacaacaaatctggatgacagcatgtctgttggcagcatgtctgtttacagcataatttactgaatattttaagcccactattgagacctactattcacaagaaaagattcctttcaaaatattactattcattgacaaagccacagatcacccaagagctctgatagagctgtacgaagagattaacgttgttttcatgactgttaacacagcatgtattctccagcccatagatcaaggattaatttagagtctcaagtcttattatttaagaaatacattatataaggctatagctgtcatagaaagtgattcctctgatgaaactgagcaaagtaaattgaaaacctagacaagattttccattctagatgccattcagaacatttgtgattcatcagatgaagtcaacatcaatgagtctagatgaagttgactccaaccctcagggaggactttgataggtttgactttggtggaggaagtaactgcagatgtgacggataaatagcaagagaactggaagtggagcctgaatataggactgaattgctgtaatcccatgataaaacttgaatggatgaggagttgcttcttacaggcgaacaaagtggtttaagatgaaatacactcctggtgaagatgctgtgaacattgtagaaatgataacaaaggatttagaatattacataaacttcattgataaagcagtggcagggtttgagaggattgactccaattttgaaagaagttctagtgtgagtaaaatgctatcaaacagctttgcatgctacaaagaaatctttcatgaaaggaagactcaaataattcagcaaaactacattgttcccttattttaagaaactgcccactgattttgtatcctgagagtttgctgaaattgcttatcagcttaagaagcttttgggctgagatgatggggctttctagatacaggatcatgtgatctgcaaacaaatattgtttgacttcttctcttcctatttgaataccccttatttctttctcttgcctgattgccctggccaggacttccaatactatgttgaataggagtggtggagacagcatccttgtcatgtgctggttttcaaggggaatgcttccagcttttgcccattcagtatgatgttggctgtgggtttgtcatatatggctgttattatttgaggtatgttccttcaaaacctagtttattcagaatttttaccatgaagggatgttgaattttatcaatggccttttctgcaggcaaatcatgaatgaactgccacatcatgaatgaactgccattcacaactgctactaagagagcaaaatggctaggaatacagctaataagtgaggcaaaggacctctttaaggagaactacaaaccactgttcaaggaaatcagagatgacacaaacaaatggaaaaacattccatgctcacagataggaagaatcaatatcgtgaaaatggccatactgtccaaagtaatttatagacaatgctattcccattaaactaccattgacattcttcacagaattagaaaaaaactaatttaaaattcatatggaaccaaaaggagcccgaatagccaagacaatcccaagcaaaatgaaaaaagttggaggcatcacgctacctgacttcaaactatactcaaggctatagtaatgaaaaaagcatggaactggtgacaaaaacagacacatagaccaatggaacagaatagagaactcagaaataatatcacacatctacaacaatctgatcttcgacaaacctgacaaaaacaagcaatggagagaggattctctattttaaaaatggtgctgggagaactgactagccatatgcaggaaattgaaactggaccccttccctacaccttatacaaaaattaactaaagatggattcatgatttcaatataaaatgtaaaactataaaaaccctagaagaaaatctaggcaataccattcaggacataggcatgggcaaagacttcatgctgaaaatgccagaagtgattgcaacaaaaacaaaaattgacaaatgggatctaattaaattaaaaagcttctacacagcaaaagaaactatcaacagagtgaacagacaacctacagagtgggataaaatttttgcaatctatccatctgacaaaagtctaatatccagaatctataaggaagttaaatatataagaaaaaagcaattccattaagaagcgggcaaaggacataaacagacgcttctcaaaaaaagacattcattgtccaacgaacatgaaaaaaagctcaacaacactgatcattagagaatttcaaatcaaaaccacaatgagatcacctcatgcagtcagaatgatgattattaaaaagtcaagaaacaacagatgctggcttgttgcagaaaaaaaaaggaatgctttcatactgttggtgggagtgtaaattagttcaaccattgtggaagatggtgtggtgattcctcaaagatctagaaggagaaaaagcatttgacccagcaatcccattattgggtatatacccaaagtattataaatcattctattataaagatacatgcacatataagttcattacagcactgttcacaatagcaaagacatggggtcaacccaaatggccaccaatgatagactggataaagaaaatgtggtacatatacaccatggaatactatgcagccataaaagggaatgagatcatgtcctttgcagggacatggatggagctggaagccattttcctcagcaaactaatgcaggaacagacaaccaaataccacatgttctcacttataagtgggagctgaacaatgagaacacatggacacatggggggaaaaacacacactggggcctgtcagggaggcagggagaggagaccgtcagaaagaatagctaatagatgctaggcttaatacctaggtgataggctgatctgtgcagcaaaccaccatggcacacgtttacctaacaaacttgcacatcctgcacatgtaccctggaacttaaaagttgaaagaaaaaaaaaaaactgtcacagtcacctaagctccagcaaccattactctgatcagtcagtggccattcaaatcaaggcaagaccctccaccagcaaaaaattatgactcactgaaggctcatatgatcgttggcatgttttagtaataaagtatttttaattaggtatgtactcttttttagacataatgctattgcacacttcataaactacagtatagtgtaaacattactttaatatgcattgggaaaccaaaaaaatcatgtgactggctttgctgtaatagtcactgtattgtggtggttgaaaccaaactcacaacatttgtgaagtatgtctgtaccagaattacactgtcttgattagtggagcgtttaaattgattttactatctggtaggataaatctttcatcatgttaatctttcccaaggcattaattattaacttcatgtttatttttcaaaaagaaaaaatttgaaacattttgttaagttttcctcaaatcattccttctcatttgttccctatcagtaatcaatacttccatatatccaggcactaaaagaacctgggatatggttcacttttcattctttctctgtcattcccaataaatcctcaagtcctatactttgccattgaattatacctcaaacacatttatttctctccaccccagctaccgcatgctagtccagaccaccattatatttcacctgaactgctggaacaacttccaaagtatcttctttgtctccagtcctgcctctcttctaatcaattcattttcaaaactagcttgaagcttctaagagtaagtaaggtcaaagcaaactcatttattttcatcataactttatttgatgagagaatcataaaatgctagtcatagaacacgttgattctttttaaacatttaacacggtctctcataatatctcagaatttccttgctgaatgatttcattaaatacattaatgatctaaatagtaaattcatttaattaacaagataggaaagaagaaacaaagttccttgagtaataagtttaaacgtaatcccattagttgataagataaatgggattaatttctaaagacatacttatctagcacctagcaaaattccatgttcatagtaggactctatgaatatatgatgaaaaaataaatgcataaattaccatatcagttagaatttcatggcttgcaacctctgctagaattaaagcaccataggggcaagaaccatgataatcttcatatagtacgtatttaataaacatttgtcaaagtctgaaacaatgtcatccaaaaacaatcacagattcaaactatcacaaatccaaaactaccacaaattccccactgtgggaagaattacaacttatatttatgcagtgttttatcatctgcaaagtgaatactattttatttgcccagatgattctcatttagccctcacaacaatccagccaatgctactatcaccgccatccagaaactaggactgaaattattaagtgacttgtccaatattaagcatcttgttaatggaaatgttagggatccaaccttggtcttctggcaccagatctagtgttcatgtgattgtgtcaaagataaaaatgactatgaccagatatttattgccagaactaagggaaagaggacactctgcacatcgttaggtagtatctagctctgccaattttcaagcctttgtatgtccccttccctgcactgggaaacgttgacctcaatacacagattaactgccaacatatccttgatggttaatcctggtaataggcaagagggattaaaaggactgcaatgcaacaatttctgactccttcaagactcaattttctccagtctagcaatattgggctcaaaatagattagtagtttttgcttttttcttgacatttggcctctatcatttaaaaaaaaaaaaacttttaaatatgcaacttttgtgggtgtatagcaggtatatgtatttatgtggtacatttgatattttgataaaggcaagcaatatgtaataattacatcatggaaaatggggtatccatcccttcaagcatttatccttgtgttacgtaagtccaattatacccttttagttatcttaaaatatacaattaaattgttattgactatagcgcccctgttgtgatatcaaatactccattttatttattctttctaactatgttttgaaccaataaccatccacaactcccaccctcagacccccactattcttcccagcctctggaaaccatcatcctactttatgtctccatgagtacaattattttgacatttagattccacaaataagtgagaacatgtgatatttgtctttccatgcctggtttatttcacttaacgtaatgacctccagttctatccatgttgttgcaaataaaaggatctctcttttacggttgaataggtactctgctgtgtataagtaccacagtttctgtatccattcttctcttgatggacacttagattgcttccaaatttttctattgtaaacagtgctgcaacaaatatgggagtagagccatctcttccatatagtgttttcctttgggggtggggggtgtatataaccagcaatgggattgctgaattacatgatagctccctttttagttttttgaggaacctccaaactgttctcctcacattcccaccaacagtgtaccatggttcccttttctccacatcctcaccagcatttgttattgcctgtcttttggataaaagtcatttaactggggtgaaatgatatctcattgtagttttgatttgcatgtctctgacgatcagtgatgctgagcaccttttcatatgcctgtttgccatttgtatgtcttcttttaagaaatgtctattcaaatctgttgcccattttctaagtgggttattcgattttttcctatagagttgtttggactgcttttatattctagttatcacctgtcagattattagtttgcattttctcccattttgtgggttgcttcttcactgtgttgtttcccttgctgtgcagaagcttttgaacttgatgtgctcccatttgtccatttttgttgtgtttgcctgtgcttgaggggtattactcaaaaactttttgcccagaccaaatgccctggagagtttccccaaacttttcttatggcagtttcatagtttgacatcttggatttaagtctttaatctattttcatttgatatttgtatatggggagagataaggttctagtttcattattccgcatataggtatcaagttttgccagcacagaatactatgcacccataaaaaggaacaagatcatgtcctttgccgggacatagatgaagctggaagccattatcctcagcaaactaacacaggaagagaaaaccaaacacctcatgttgtcactcataagtgggagctaaaaaatgagaacacatggacccagggaggggaacaacacacccaggaccctgtcagggaggcagggggagggaaagcaacaggataaatagctaatgcatgtggggcttaacacctaggtgatgggtggataggtgcagcaaaccaccatggcacatatttacctatgtaacaaacctgcatgttctccatgtgtatcctggaatttaaaataaaattaatttaaaaaaaaaagactgtttttttcccaatgtatgttcttggcacctttgtaaaaaatgagttcactgtagatgtgtggatttgtttctgtgttctctattctattccattggtcaatatgcctgttcttatgcagtactatgctgttttggttaccatagctctgtagtataatttgaatccaggtaacgtgattcctccagtgtggttcttttcttctcaggatagctttgtttcttctgggtcttttgtagttccatataaattttagaattgcattttctatttctgtgaaaaatatcattggtatttgagtagggattgcattaaatctgtacattgctttgggtagtatggatatttcaacaatactgattttaccaatctatatatatgaaatatcttttcattttcttgtatgatctttaatttcattcatcagtattttatagttttcattgtagagatctttcacttctttaggtaattcctagttatttaattttagttgtggctattgtaagtgcaataactcttttgatttctttttcaggttgttcactgttggcatatagaaatgctactgatttttgtatgttgattttgtatcctgacactactaaatttatcaattctcattctttttggtggagtctttaggtttttccaaatataagatcatgctaggtgtggtggctcacacctgtaatcccaacactttgggaggccaagatgggcggatcatctgaggtaaggagttcgagactagcctgaccaatgtggtgaaaccctgtctctagtaaaaatacaaaaaaaaaaaaaaaattagctgggtgtggtggtgggcgcctgtaatctcagctactcaagaggctgaggcaggagaatcgcttgaatatatatagccaacaagaatactttgacttctacctttccaatttggatgccctttatatctttctcttgttggattgctctatctaggacttccagtactatgctgactaacggtggcaaaagtgataatccttgttgtgttccagatcttggaggaaaggctttcagtttttccccagtcagtatgatactagctgtgggtctgtcatatatagctcttattatgttaagatatgttccttctatactcagttttttgaaggttttctgtgatgaaaggatgttgaatttcatcaaatgctttttcagcatcaattgaaatgatcatatggtttttatcctttattctgttgatatgatgtattatattggttgatttgcatatgttgaaccatccttgcctcctagggataaatcccacttggtcatgataaaacatctttttaatatattgttgaattcagtttgctaacattttgttgaggatttttgcattaatattagtcagagatactgaccagtatttttttttatgggtctttgtctggttttggtatcagggtaatgctggtcttgtagaatgagtttggaagtattctctcctcctctactttttggaatagtttcagtaggattagtattagttctttaaatgtttggtagaattcagcagtgaagccatcaggtcctaggcttttatttgctgggagactttttattacaccttcaatctcattacttgttattagtctgttcaggttttgaatttctttatggctcaattttgataggttgtctgtgtctagtaatttatccatttcttctgggttttccaatttatcggcctatagttactcatagaacccattaatgatcctctgaatttctgctttataggttgtaatgtctcctttttcatctctgaatttatttggatcttctctctttttttcttagtctagataaaggtctgtcaatctgagtctggctaaaggtttgccaatgtttatcttttcaaaaaaacaactttttgttttactgatatcttgtatggatttcttcatctcaatttcatttatctctgctttgatttttaatatttcttttctactaattttaaatttggtttgctctagcttttctaattctttaagatgcaccaattggttgtttatttgaagtgtttcttccttttgatgtagacacttataggataaactttcctcttagtactgctttcactatatcctatacattttggtatgttgtgtttccattatggtttgttttgagaaatttttcaatttccttcttaatttcttcattgacccctggtcatttcagggcatattgtttaattttcatgtgtctgtatagtttccaaaattcctcttgttattgattatatttattccattttggccagagaaaatgcttaatattatctaaatttggttgaatgttttcaaatttgttttgtgagctaacatatggcctatccttgagaatgatccatgtgctaaggaacagaatgtgtattcttcagtcactgagtgagatgttttgtaagtatctattaagtgaatttgatgtatagtatagattaagttcaatgtttctttgtagattttctgtttgaagatctgtccaatcctgaaagtgggatgttgaagacctagctattattgtattaaggcctatctgtctctttagctctaataatgtttccattatatatgtgggtgccccatggttgggtgcacacatatttataagtgttatatcctcttgctgaattgacccttttatcattatataacgaccttctttgtctgacttgtcttatagtttttgtcttgaaatctactttgtctgatataaatatagctattcctattcttttttggtttccagtggcttggaatatctttttccatccttttattttcagtctatttgtatctttatagatgatgtgtgtttcttgcaggcacagatcattggctcttgttttttcacctattcggccactctatttgaagtcagtcttctcattcagactctcattcagtattctcttccctctttccttctgtcttttctcccttttagtgaaagtgattttctctggtgctatgatttaatttcttcctttttattttttgtatatccattgtatgtattttgatttgaggttaccatgagccttgcaaataccatctaataatccattattttaactggtgacaatttaacaatgattgcttaaacaaacatgcaaaaagtaaactaatgaaggctctacactttaactttgtctgcctgctttttaacttcttgttgcttctctttatgtattattgtattgtgtatgtcttcaaacgttgttgtagttgttatttttgattggctcattgtataatctttctacttaagatatgagtagtttacatgccacaattacagtgctataatattctctgtttttttctgtgtgcttattattgccagtaacttttgtacctatagatgatttcttcttgctcattaacatgctcttctttcagatttaagaactccctttaacatttcttgtaggacaggtctgttgttgatgaaatcccttagctttggtttgtctgggaagatctttatttatctttcatgcttaaagcatattttcaccagatatactattcctgggtaaaagtttttttccttcagccgtttaaatatgtcatgccattctctcctggcctgccaggtttctactaaaaagtctgctgccaaacatattggagctgttatttgttatttgtttcttttcttttgctacttttaggatccttcctttatccttgacctttgggactttgattattaaataccttgaagtaatcttctttggtttaaatctgcttgcattctataatcttcttgtacttgaatgttgatatctttctctagatttgggaagttctccagtattatccctttgaataaactttctacccccacctcctctttaaggccaataactcttagatttgaccttttgaggctattttccagagcctgtagttgcgctttattgttttttgttgttttttcttttgcttcctctgactgtgttttttgttttgtttagttttttgttttcttgagatggagtttcgctcttgttgcccaggctgaagtgcaatggcatgatctcagctcactgcaaccttcacttccttggttcaaacgattctcctgcttcagcctttaagtagctgggattacaggtgcccaccaccatgcccagctaattttgtatttttagtagaaatggggtttctccatgttggtcaggctggtctcgaactcccaacctcaggtgatctgcctgcctcagcctcccaaagtgctgggattacagacatgagccactgttcctggtctgactgtgtatttttaaacagcctgtcttgaagctcactttcttctgctgcttgatcaattctaccattaaaagactctgatgcattcttcagtgtgttgattgcgttttttcagctccagaatttctacttgattctttttaattatttcattctctttgttaaatttatgtaatagaattctgaattccttctgtatcttatcttgaatttcttttgagtttcctcaacacagctattttgaattatctgtctgaatggtcatgtacctctgtttctccaggattagtccttagtgccttactgagtttatttggtgaggtcatattttccaggatggtcttgatgcttgtagatgttcatcaatgtctggacactgaagagttaggcctttattgtagtcttcgcagtacaggcttgtttgtgcctgtccttcttggcaaggctttccagatactcaaagggacctaggttctaagccccctaatgctgtggtttttgcagactcatagaagtatcattttggtgatcttggataagatctgaaatgattctcttgattaccaggcagagactcttgttctctttccttactttctcctaaacaaatagagtcagtgtctctctctcaatctctcgctctctctctctctctgctgagccacctggaacttggggtatggtgatgcaagcacccctgtggccacagccattgaaactgtgctctgtcagacttgaagccagcacagcactgggtcttgccccacacacactgtaaacactttctggctaccacctctgttgactcaaggcactagggctcagtgatcagcaggtagcaaagccagccaggtctgtgtccttccctttagggcgggaagttcccctaggtcctgggtgggtccagaaatgctgtttgagaagcagagattggagtcgaaaaccttttaagtttacctgatgttctattctactgcaggtaagctggctctcaaaccacaatacaaagtccttcctagtcttctccttactgtttttctaatgcctgattatggatcctagacttgtttttgtacttgaatttttacaatagtagcaggcctaggactgtgttctctgccttggtctttgacagttctcttccaagagattgatgtccagtccctgaatcccaaacaggtcctttaggccctgtgccacctaaatttacagctccaatgggaatgaatagctttgatgctttgccttacttagattcctttatcctacctgctactgtcaattgtgcaatgtgcagaccaaatagtactgcttcaaagtgactaatcatgcatactgacagcacttaataagtaaagagaacattatgccccccaagaaaaataaatattggcaataagaaatctatataataagcgttcatacgttgtttacactgtgttttctataacatttaaaactatcagtggtgggcagaatataacaagtcaaactttattagtgactcagtaaaaggttctatgcttcagtagagaaaagagttataaaaaattcatcatggagctatgtggattagcaatactatgaaaaaaatattaggagttacagctgacagtatgagtcagactgtaacatgccagttaaagaaattaatgtgacattagctgatttaatacaagtatgatatttcacctagaaagagtgacaggcctccactcttcagtgctaattagtattgggaatgatctggcttcacaatttcataaaaggcgggctaactggattgtgctgaatttcctttagtaaggctgtgcaaggtcttattcatcaaagagactgggggagacttggccttctgacttacgaaagatcttagcaacaatcaggaacccagaggtagacacagtagttgcccaaaagtaccaataatgtagtttttcaaatcagaaattaggtggcctagaggcttttctagactactttgatagggcatctcactgaatttgcttcctagcacagctctattcttagccacatgggaaaactaaagcatcttaattgacactacaggggaatcacacatgatgcacttggcttggtgctggggctgacacttgaggagaggcaaagaccaaatggaccgttttctgtgaacataagtgaggaaaatggtgagtattaaacccctgtcatgtgagaaaagattaaataagaaaaggtgctgaggaacgtgtatgacaaacatttaaaaggtaaaatagtgattagaattgttatctatctctaaggaagtagaaataatgcagatggggagatggtaacagggacagatattgcagctgatgataagatttctaataattagagctttgcagtataaaactggctgcttactaagtagcaaactctctgtccctggagtcttcaaggctagcctgatctatacaaggcatcttcttttttttttttttttttttgagacggagtctcactctgttgcccaggctggagtgcaggggcgcgatcttggctcactgcaagctccgcctcctgggtttacacaattctcctgcctcagcctcccaatagctgggaccacaggcgcccgccaccacgcccggctaattttttgtatttttagtaaagacagggtctcaccctgttagccaggatggtctcaatctcctaaccttgtgatccacctgcctcagcctcccaaagtgctgggactacaggcgtgagccaccacacccagcctatacaaggtatcttctgagtgtagaagatagcagtttgaattagacgagttttaagatgctaagtaaatgagagaatcagaatagaagttttgtattagtactatggtacaagttacctgaatatattcactgcttcctgaattttttctgataatgggggaagtaacactaatacaagagtgtgggtttatggcttttttaaagttagaaatgactcacagttccaaatgactcaaggtaggtgaaagtttttggaagtggtctgactactctgacatcttcccacaatatcaagaaaaagtatcccctgaagatttacaatgacattcaaataagaaaaactacaacatgaatatgaaatcagaagaaaaataacttttttttaaaacgaagatactttaggtgggagcaaagaatgaatgacagaaaggcagccatgggggaaggagcatcacgtaacagtggtaggcagaataatggctctgaaagatgtccatgtctgaatccctggaaactaggaatacattacgtaacacatagcaaaaggaactttgcagatgtaagtcaaggatcttgctatgaggagatcatactgcattatccaggtggcccactatactcagaaaggacattataagtagaagagggagaaaggagagccagtgtcagtgatgcaacacgaggtatctgactggctgtcactggttttggagcttgaagttagccatatgtattagtctgttttcatgccgctcataaagacatacccaagactgggtaatttataaagaaaaagaagtttaatggactcacagtcccatgttgctggggaggcctcacaatcatggcagaagagcaagggacgtcttacatggcagcaggcaagagagaacgagagccaagcaaaaggggaaaccccttataaaaccatcagatctcatgagatttattccctaccatgagaacagtattggggaactgcccccataattcaattatctcccacaggatccctcccacagcataggaatcacgggaattctgggagctacagtccaagatgagatttgggtggggacacagccaaatcatatcaccatgaatcaaggactgtgagcagctcatagaagctggaaaaggcaggaaaacagattcttccctagagcctccagaaaggaaagcagccctttctatattttcgactggtagggcccattctggacctccagaactgaagaataatacatttgtgttgtttttttatgccactaaatgtgtggtaatttgttacagcagcgttaggaaacaaatgcaataatataccagcagaaggcatcacacagggaggcatgggctaagagaaggacataaaattggacaccagtgggaaaatacaccttatcattttgtactgactcagtattttaaagatggtgattctttctcgtttttaaatgtaatacaataccattgcaatacagtttccctccaactccaacttagttcttgacaagtaagcctaaagtgcatttggaaaaataaatgtgtgacaatagacaggttatcaatttgaaaagagaaaggtaatggagggagtggagatcaacctttatcagatatttatgtaaactacaaatggttctggtacaataattgaaaggcaagataacagaaaaaatactttaaaagaaggttctgatgcttgcagaaacttattacattataaaggtggtatttcaaatcagtaagaaaaccacgggttatataataattgtcagtgaggtaaccaactagtcatttagagagaaataataaacttgaattactactgcattccttatatcaaattaattcctgataaagatttaaacaattagcaaatatatttgttataataatcttgaaataagaataacttttgaccagaagctacaaccagacacataaccaaggttgtacagaaaaagattgataaatttgaatatatactactattaaatttgtataaagaaactaaaatatcataaagatcaagagacaaaaaatttgggaaaattctttgacaaatataacaaagggttaatctctttaatatatataaagataataataaattgagatgaaagagaccatcaacctaagagaaaaaaatgagcaaagattacaggcagttgtaaaaatagctagaaatttcttacatgaaaagatgctcaacttcatttataattaaatatatgtacatgaaagcaagataacacaccattcttgatcaaattgctgtagataatacacagtgttagtgagggtttgaaaaaaatgggcactttatataaaagttaaaagactaaccatctgttagtcaaagtgtgaattgatgtaaacctctttctggctaatttgtcatttgttacaggagatcgttagaaagcagatctttagacagcatggactttagaacttttgccatgttaaaatttttccctcacctcggaacaggtgggattgataaactaccattactatttctaaaacatggtactgtaaagcaccatttacaggcattgcataattattactctatctaaaaaatgctaaatgctggatatgctgtatgtttctattaaataataaaatgggagtgtgggtggagggaagcctgcctcttggtgtcatgcatgagaaaaactaatcagatctcaccaatatcaatcgtctgagctgtgaatgggtgtcgggatagcatccctctttagaagttactgatgaaaccccatgaagcttgattcttagataagccttgcttggtcagccacttcaaaattggaggtaccaatttaacatttgaaaacaaaaaatctcaacaacaaagttctgagaaaccagtgtgggtactacctaagaatgttactttgggtatgatatgggttaaactatgtcctcccaaaattcacgtgtcaaagtcctaaccccagtacataagaatgtgacattatttagaaatagggtcactgcagatgcaattagttaaatggagatgaggttattagggtggaccccaatccaatgacaagtgtcgttataaaaagaagaaatctggagacagacttgtacacaggtataacatcatatgaagattggagttatgctgccacaagccaagaaatgctaaacattgtcagaaaaccaacaggaatggaacaaattctctctcacagacctcagaaggaaccagtcctgctgacaccttaattttgaacttctagcctttagaactgtgagacaataaatttctgttaaggtatgcagtttgtagtactttcttatggaaaccctagcaagccaatatagagttaaaaaaaacagtaaaaggtactcgttgaaaaacttttgattaatctcttagcattttaacatatttactccttgggaaaaaaataacaattagggactatcaaaaaaggggattatctttcttcttgataaaattcccaaaagtgtaataggtatcaaaattttaaaatcacgtaccctttaataaaataaataagtattgttgctgtaaacaggcaatatagtacaatatagaggtctacagactttagactgcacaaagtccacctggatcacttgttagtaatccggatttgtggctctccccggaattcttactaaatcggaatctctggtggtagccatggagagttatatcttacaattatcccaggtcatgttgatgcaaattgttggtgaaatatacttggaaaatacaggaagagtagttcaagagcatgagccctttaactggagtcagaatcccaactctgccttttttaacaaagttgccttggcaaagtcttacagtttcctcatctgcaaaattagaatagtaatagtatctgcttcaaggttttgttggtagttgtgaatgaaataataaaatcaataaataactttgattaaaatgtatcaaaccaccaatgacattcttaacataatgagaaaaaaactattttaaaattcatatgggaccaaaaaaaaaaaaatggcccaaatagccaaggcaattctaagcataaagaacaaagttggaagcatcacattacctgacttcaagctatatactacaaggctacagtaaccaaaacagcatggtactggtgctacagtagacacatagacaagcagaacagagtagagagctcagaaataaagccacatgtctacaaccatttgatcttcgccaaacctgacaaaaacaagcaacgggaaaagtactccctattcaataaatggtgctgggataactggctagccatatgcagaaaattgaaactggaccccttccttacaccatatacaaaaaatcaactcaagaaggattaaagacttaaatataaaacctaaatccataaaaaccctggaagaaaacctaggaaataccactctggacatagaactagacaaagatttcctgatgaagatgccaaaaacaattgcaacaaaaccaaaaattgacaaacgggacctaattaaactaaagagcttctgcacagccaaaaaacagaacaaaaacaaaaacaaaaaaaaaaacaaaaaaaaaaccatcaacagagtaaacagacaacctacagaatgggagaaaatatttgcaaagtatgcatctgacaaaggtctaatcccaaatctataaaaaacttttaaaaaattacaagcaaaaaaaccaaacaaccccattaaaaatgaggaacataacatgaataaaatgattcatttcaaaaagatgattcatttcataaagcacttagtctagtgtctaaaagcctaagtgatcaatcaatgtagccattattactactcagtaatttttaaaatgagataaatgtgcaagtactgatatgttaagctaaaacaataaacaaagggaagaataatatgtgatgtatgttcatatctgtgtgaaaaaagtatgcactcaaattatatattcctggaatatttctagaagatattattagaaacatttggtgtttaacactgggaaatgagatcatattctcttttgctttgcttgatttaaaaaaattatatgtacatgtgattttcagggaaaaaatatagtttgtgaatctaccacctgaggaaagagatgataccatttcaaatacaaatgagctttgatttttatttctggcactactgtgtagaaatttgcataccccaggtgaaattggaaatggtgaaatcccaagaataatctctgtaatgaatcatacaaatgcaactgaaaacatgccaaatgtcaggtaaaactaaataggaaccacctttgtacaaatcctcaaaaaaagacctagatgatctagatcagaagtcaacaagaagtcaaaagaagtggaatgtagttcaccaataagaagatgacaaagaggagaatgttcacctagactcgaacccttgaaccatttatctttctcttgttctatcatgcttactgtttctgtaaagaagccatcaacaagttgggcgtattagctcacacctgtaatcccagcactttgggaggctgagatgggccgatcagctgaggtctggagttcaagaccagcctggccaacatggtgaaatgctgtctctactaaaaatacaaaaatgagcagggcatggtggcgtgtgcctgtaataccagctacttgggaggctgagggaggagaatcacttgaacctgggaggcagaggttgcagtgagcaaagattgcaccactgcacaccagcctggtgacacagcaagactctgtttccaggaaaaaaataaaagaagaagtagtcatcaacttctgtaagcttttcacttcctaattacccttaaatccacactatttttctacgtccataatcactaagctagttcaagcttcatcagctcatacctatgttacatatttaaataatctccaaactcccatctaatttagctccattttaaccaggagttcccatcattctgaatactaaaacatttttttcgaagtaaaaatttttacagattctctaagtgataatattaggattaatttaggaatgtagacagtataataaatgactttcttatttactctctaaattatagataagagtccagggttcaagaaaccaaccagagattttaaacatttaggctttgcaggccacatggtctctgttgtaactactcagtattggtgttgtagcacagaagcagccacgtacaatatgtaaatagaaaagcttgtccagatttggcctgcagtgagtcagaactgtcctagtgaccacagattgccagactgtggcaaagaggtcatgcaaaagagtttaaaacatcagtaaggctagtgatgaagcagatactggtttaggcccttggcagtgtaggcttcctactcctacactctagaactacatagactggcatcaggtctcccaagcgagttctttattgctaggcttaccttacatactttctgcaggtgagaagatcacaaagagaataagtgacacaagctcagtttctgctcccaagtttaggagtcagttaacttccctgagaaaagaacaggaacagagagaagcccagtcacacttatccataactctccacgtgaaaatacaaagtcaggggaaagaatctcactttccttgcccaactgcaacaggtaagttgtaccactgtattaaaaaaatcagcaaaaagcaaaagtgattttccatttttattaatcacaacaaaacttatgcaaattttaaaataataaatatggacatggatatgtaaaacctaccatttatttaatctacagacagaggttagtatctgtatggattttcaagcccttttcagcaaccccatagtggcccacttgagatccacagcttcataccacttctaaaaggtagggactattataaccctcacagtatagtactgtcagaggacaatcatgatcatccaataaatatttgttgaataaaaatatgaattttatactaatttattctttaaagctttcaaagcctctccaaggataccttttaatacaaaccctctcttcccatatgcctgatatactcagtagcctccatcctgaatgacatattcctgcctctgtcttcttgcttatgttctccttattccctctgagtagcagggccctcccaggcctatagaaattctccctttccttcataggcaatcataaattctacttagtccagtaagaattttgtggctacacttgactacatagcttgctttcttctctgaacctaaaaacaacagtaatattctgtttgatattaaatcagtatctcatgacacattagcttttcaggactgcatttataatcaatatttttattgttagctacttttgttgttgttgtagtatacatttttatttttactttttatttcaatagctttaggaatacaagtgttttttggttacatggataaattataggaacctcccaactctccccccttctgagtctccagtgtcaactacaccacacagtacacctttgtgtacctataacttagcttccaattataagtaggaatatgtggtatttggttttctatttccaagttacttcacttaggataatggcttccagttccatacaaggtgctgcaaaagacataatttcattctttcttatggctgagtagcattccatggtatatataccacattttctttatccggtcatcagttgatgggcactgagattgattccgtatctttgcaattgtgaattgtgttgcaattaacatatgagtacaattgtctttctaataacttccttttctttgaggaaatacccagtagttggattgttcaatagatggtagatgtgcttttagttctctgaaaagttgccacactgttttccatagaggttttactaattcacattcccaccaacagtttataagcattctcttttctccgcatctgaaccaacatctattgttttttgactttttgaaaatggccattctgactagggtgatcttgtagctcactgtggttttaatttgcatttctctgatgattagtgatatcgagcatgtgtttgttggccatttgtatgtcttcttttgaaaaatatctgttcatattgcttgtctactttgtaacgggattgtttttttttttcttgctgatttgtttgagttccttatagattctgcatattagtgctttgtcagatatacagtttgtggatattttctcccattctgtaggttgtctgtttactttgtggattatttcttttgcagtgcagaagctttttcatttaattcaatcacatttatttttgttttgttggatttgcttttggggtctgtgccctaaattatttgccgaaggcaatatccagaagagttttcctaagttttcttctacaatttttatggtttcaggtcttacatttaaggtttttttgttgttgttgttgtttgcttgtttgtttgtttttgagacggagtctcgctctgtcgccaggctggagtgcagtggcccgatctcggctccctgcaagctccgcctcccaggttcacgccattctcctgcctcagcctcccgaatagctgggactacaggcgcctgccacccaacctggctaattttttgcatttttagtacagacggggtttcatcgtgttagccaggatggtctcaatctcctgacctcgtgagccacccacctcggcctcccaaagtgctgggattacaggcgtgagccaccacgcctggtcacatttaagtttttaattaatcttgagttaatttttatacatggtgagagataggaatccagttttcattcttctatacgtggctattccattttctcagcaccatttattaaataggatgtcctttccccagtgcatgtttttgtctgcttagtcaaagatcagttggttgtaggtattttgctttgtttctgggttctcaattctgttacatttgtctctgtgcctattttataccagtaccatgttattttggttactattatagccctgtagtataacatgaagtcaggtcatgtgatgcatctagatttgttctttttccttaggactgcttttgctagttaggcttttttggttggttccttgtgaatttttggattgtttcttctaattctgtgaagaatgacattggtattttgataggaattgtattgaatctgtagattgctttgagcagtatggtcattttcacaatattgattcttccaatccataagaataggatgtttttccatttgtttgtgtcatctatgacttctttcattggtgttttgtagttctccttggagagacctttcacatccttggttaagtgtattaggtattttattaatattatattattttgcagctattgtaaatgggattgagttcttcatttcattttcagcttggtcattgttggtgtatagcagtgctactgattagtgtttatgttgattttgtaatctgagactttagtgaattcatctatcagatctaggagtcttttggaggagtctttggggttttcaaggtataagatcatatcatcagcaaaagaagatagtttggcttcctcttttccaatttggatgttctttctttctcttgcctgattgctctggctaagacttccagtactgtgctgaatagaagtgatgaaagtgggcatccttgtcttgttccagccttcagggagaatgctttcaacttttccccattcagtatgatgttggctgtgggtttatcatatatggctcttatcattttgaggtattttagctactttttagattctaccctcccagtgagctagtgctccatttggtgtttcatttgtgtgtgtgtgcacgcttctattttatgcttcacagaaatccatacaattcctacacagagtagactttcaaaatattgaattatttatgttaaatgactcaattaattaacaaaagaatggataaataaataacataaatgaccaatattaataaaaattaagtcttaaaaatatggagaaaaacttgaatggcctcccaaaaccttccaatccctgtgctattttaacagaaacattaattatttttaaaaaaccctctttgtagtcatttacttcacagagacaagaaatatggtaacataaaggtaaataatataaatctgtgacttgaatccttgaaaaatctggaacaacaaaaatattgacaaataatatcattgtttaaaatactgaagaagaatatattgcaatgacaatatgaaaatatgttttggtatctccagtctcagtcttgttagaagtatgttcagaagtgaacaactgaatgagaagtgaagtgctcataggggaaggataagtccagaaatctgaatttagtcccacatagcaatgaatgtttctcaattatacaaattacagtcaccacttcagtgataatcatgtcatttgccatttattgttttcactcatcaagggataaagaaaaataaaagatgaaagttacttgaaaaataatgatgaatccatatgctgagagaaaagcattgtgttctaaatgacaaccaacacctgaacccaggactcacttatttggttaattaatatacattcgaggctgtgaaattgtcatttctacacataataattaaacaccattaatggaaacacctaaaataactacatttgctttctcagagaattacacattaggaaagtaagttaatgtgataaacattttacaatatatttagacttttaggaaactttttttttcttttttcttttctttttttttttttttttgagatggagtctcactctctcacccaggctggggtgcagtggcattatttcggctcactgcaagctccacctcccgggtttaccccattctcctgcctcagcctcccgagtagctgggactacaggcacctgccaccacacccggctgattttttctatttttagtagagacggggtttcaccatgttagccaggatggtctcgatctcctgacctcgtgatctgaccacctcggcctcccaaagtgctgggattacaggcatgagccaccgcgcccggccctttttaaaaaattaacgtgatttaggaggccacttgaagatattcagcttttgatggcataaaattctggctttaataaccaaccactagttatttaatatgattgtgtacctgcaaaaagcttaagaaacttttagctaaatgaaggaattctttaagaagacaaaataagaattagtcacatatctgcttttccactattcttgttaccattactctaccagcatccctgcaaagcagatcagcaatatttgtgtgttttgaaactcctctggtttcctggcttctaagatccagtccatcaccaagtcccatgattggtccactcttgttgtcccacgtccatgttaaactaggtttcagcatcacacatgcagattaatgtcactgtctctgaactcatctcccttcttggacagcttcacttcatcctatataccaccattagaagaatctttgaacacaattattctcaaattattcctagcccaaaaactcaaatactttctaaataaattttattcaaatcaaaactctctagcatagcgctgtatatcccaacatgccaatttcaccttctttatttcattttccattcaactgtatgccaaggctctactttgagctcatctgcttgttagatcagcttaacactgaatttgaacatgccttacctcacaattctacttcttcaagttcttcacctattttaaaagccagtgaagaagcacttacagaggtagaataagaatctccagaactccactccttcataaaaggcacaggaacactcaaaaagttgtcaaaataaactttagcacttaaccaaaggtttgcaataatccatcaaggatttattcaagaaaatcatcagaatttttgtgaaaacagttaacattgtgtatttaaatttgctctaatcccatttccatctccccagctccacaacagtctcacaatcactcttaaaaccaacatatactagagggcgttaaatgggtttggagctctacaaactgtcttgcactcacagagaattcatatttgatgtatgcagcagctccctggaaaagctccatttataggacatgtctttatttgacctgatacagaactcactcagtgggaaaggctctgttcttaagatgttagtcaaaatcaatcctgacccatagaatgtacatcaagaatgaaccctaatgcaaactatgaactgagggtgatgatgatgtgtcaatgtaggttcatcaattgtaacaaatgtagcactctggtggggatgttgataatgggggaagctacacatatgtatgggggcaagggagatatgggaaatctctgtactttcctcttaattttgctatgaacctaaaactgctctaaaaaattagtctttattataaacaaaactatgtatttttctacaatcaaatttcttcacagctatatgttcttagctcctttcatgcttttatgtgtttgtataccttttgtgttccagtggttgggaatagttttgtgaaaataaaaaatatttccataaagaaaaaaagctagaaaagttgttgctattagacctactctataagaaatatgaaatttttattttaatttaaattttgtgtaggtacacagtaggtgtatgtatttatagggtacatgggatgttttgatacaggcatgcaatatgaaataagcacattatgaagaacggggtatccaatccctcaagcatttacccattgagtttcaaacactccaatcacactctttatttttaaatgtagagttaagttataatttattatagtcaccctgttgtgctatcaaataggtcttactcattttttctaagtacttttgtacccattaaccctccccaccttaaccacaaaccccacactaccattcccagcctctggtaaccatcctccaactctctatctccatgagtttgttttgctttttagatcccacaaataaacaaaaacatttgaagtttgtctttctgtgcctggccaatttcacttaacataaagatctccagttccatccatgttgttgcaaatgacttgtctagatctcattatttttatggctggatagtactccattgcgtataagtaccacattttctttatccattcatctgttgatggacgctttggttgcttccaaatcttagctattgtaaacagtgctacaataaacataggagtgcagatatctcttcaacatactgatttccttttctttgggtatatatccagcagtgggatcgctggaccatatggtagttctatttttagttttttgaggaacctccatattatcctccataatggttgtactaatttacattcccactaacagtgtataaggttttcctttttctctacatcctcaccagcacttgttattgcctgtcttctgaattaagccattttaactgggtaagatgatagctcattgcagttttcatttatatttctccaatgatcaatgatgttgaacaccttttcatacgcctgttttccagttgtgtatgtcttcttgtgagaaatgtatattcaaatcttttgctcatcttttggcaaagttattttcctatagagttgttcgcacactctatatattctggttattaatcccttgtcaaatgagtagtttgcaaatattttcttccattctgtgggttgtcctttcactttattgattgtatcctctgctgtgcagaagctttttaacttgatgtaatcccatttttccatttttgctgtggttgtctgtgcttatggtatattgctcaagaaatttttgcccagaccaatgtcctggagaatttccccaaagttttcttatagtagtttcatggtttgagggatttgatttaagtcttaattcatttttatttgatttttgtaattaatgacaaataggggtcttgtttcattattctgcatatagatatccagttttcccagtaccatttattgaagagactgtcttttccccagtgtatgttcttggcacttttgtcaaaaatgagttcactctaggtgtgtttatttgtttctgtgttctctattcttttccattggtctatgtatatatttttatgacagtgtcatactgttttggttattgtagctttgtagtataatttgaagtcaggtaatgtgattcctccagttttgttctttttgcttaggatagctttggctattctggtttttttgtggttccatatacatttttggattatcttttcctatttctgtgaagaatgttattggtattttgatagggatttcattgaatctgtacatttctttgggtagtacaaacattttaataatattgagtcttccaatccatgaacacggaatgtctttccatttttctgtgtcctcttcaatttctgtgtcaatggtttatagttttcatcatagagatcattcacttcttttcttaattcatttgtttttaatcttatgtgtggctattgtaaatgggatatttttatttctttgtcacattgttcactattggcacacagaaatgctactgatttttgtatgttaattttgtatcctgctactttaccaaatttactagttctaatagttttcttgtggagcctttaggtttttctaaaatcatatcacctgcaaacaaggataatttgacttacacctttccaatatggaggccctttatatctttctgttgtctgattgctcttgctaggacttccagtactacgttgaataatagtggtgacagtgggcatccttgtcatgttccagattttagagaaaaggctttcagtttttctccattcaatgtgctactagctatgggtctttcatatatggctttaattatgttgaggtatgttccttctattctcagtttttgagggtattttatcacgaagagatgttgaattttatcaaatgctttttcagcatcaatcgaaatggtcatatggtttttatccttcattctgttgatatgatatatcacattgatttgtgtacgttgaatcatccttgcatcccagggataaatttcacttgatcatgatgaatgatagaaatactaaattattaaagggaggctttctggctgaaaagacagtaaacagtaatgcaaattcacactaaaaaacgtaaaaagtgtgggtaaaggtaaatataagatagtataaatgtacttttatttatactcttttcaccacccttatgccttaaaaaatcaactgcataaagcaataattacaaatctctgttgatgtgcttatatgaagatgtaatttgtacaaaagcaacaatacaaataagggaggaggaaatattggggcaaagtttttttgtatattattgaaacaaactgttgatattaattcaaaatagattattttaagttaaaaaatcaattataacctctagaataccaactaaaaaataactcttaaaaatatgtatgaaaaacataaaggaaattaaaagaataaactagaaaatatctatttaatacaaaggaaggcagtaatggaggtatagagggacaataatgatataagaaatattagaaacaaatagcaagatggcaggcataaatactaccttatcaacaattacattaaatgtaagtagattcaacactccaaacaaagagatgagcagaatggactcttctgtttttgtttgttttaggttttgcttttttgttttcttatagacagggccttgctgtgttgcccaggctggtttcaaattcctggcctcaagggatccttctgcctcactctgcctgccacaaaatgctgagattacagacaagccactgagccaagccagataaattttgttcaaaaaatgatccacatgttgtccataaaagatacacttaatattcaaagacattaataggttgaaagtaaaaatatgaaaaaaagatacatcatgcaaataacaaccaaaagataacttcagtgactatactaatattgaacaaatagactttgagacaaaacttgtcactagagacaaaaaaaaagacattttataaagataaaacagtcagtcaggaagacacaacaagcataaacatatatacacctaaaaatagggcctccaaaacatgaaacaaaaagtaacagaattgaagggagaaatagacaattaaaaaataatagttggagacttcaatatcacattttcaataatgaatagaacaattaggcagaacatcaaccagcaaacagaagacttaaataataccataagccaagtagacctaacagacatctatagactactctaccaaacaacagcagaatgtgcgttcttcttaagtacacgtgaaacatcctgcagaatagaccatgcaatatgagacttgccataaacaagtctcaatacattttaaatgttttatgtcatacaaggtatgttctctgaccataatagaaaaaaattagaaaacaataaaaatgaaaattgagaaattcatgaatatgtggaaatagtcaacatgctccttaattagcaatgtgccaaagaagaattctgaagggatattaaaaataatttcaaatgaatgaagacaaaaacacaacataccaaagcttatggaatgccgcagtgcttagagagaaatttatagctgtaagcctatttttaaaaagacataagtcaattataacctttagtattaagaaactagaaagaaatataaattgaaagcaagcagaaaagaggaaataataagagcaaaaataaatgcaaataaagaatagaaaaacaataaagaaattcaaagaaatgtaagttggttctttgaaaaaaaatacaattgacaaaatttcaggtagactgaacaaaaaaaaagagagagaagactcaaattactaaaatcaggaatgaaagagaagctatcactaccaactttacagaaataaaaaagtttataaggaatactatgaataactccatgccaacaaaacagataggctagctgaaataaacaaaatcctaccaaaactgacttaagaaaaaataaaaatatctgcgtagacctataacaagtaagagattgaatttgtaatttcaaaactttccatatattacggccaggctcagatggcttcaaaggtgaattaaaccaaacatttaaagaagacaataacaatccctcacaaatgcttctttaaaaaaaacaaacaaacaaaaaacacaaaaaaggaaacactttcaaattcattttaggaatcttgtattacactaatatcaaaaccatataaacacatcacaagaaaagtagacatcaacatcccttataaatgtagacacaacaaccttccacaaaatgctggcaaactaaatgcaacaacatacaaaataattatatatcatgaccaagtgcctcaggaatacttggctggttcaatatatgaaaaatcaaccaatatcatacactatattaatagaataaaggacaaaatccacaaaatcatctcaacagacacagagagtgcatttgacaaaatgtaacatgcttctggtcgggcatggtggctcacatctataatcccagcactttgggaggtgagtgaatcacctgaggtcaggagctcgagaccagcctggccaacatggtgaaaccccatctctactaaaaatacaaaaattatctgggtgtggtggcagacacctgtaatcacagctacttgggaggctgaggcagaagaaccacttgaacctgcggagcggaggttgcagtgagccgagatcatgccactgcactccagcctggcaacagagcgagactccgtctaaaaaaaaaaaagagtaacatgcttccatgataaaagcactcaacaaactagaaagaatgagaattctctaaatctgataaaggcgtctatgaaaaacctacagctaagattctatttaatggtgaaaaactgaatatttccccctaagatcagaaacaagaaatggatgtcactcactatttccattcaacattgtactgaaggttctagtcagggcaatagataggaaaaacaaacagcatccagattggaaagaaagaagtaaaactatcttaatttgtagatgacatgaacttacatatgtagaacaatcctaaagaagccacaaactttatttgaaataatggacaagttcagcaagtttgcagatacaaggacaatactaaaaaaaccaattgtatttctatatggtagtaatgggaaatgcaaaattaaatttaaataaaatttcatttacaatagaataaaataaattacttagacatgaacttcacaaaaaaaatctaagatttgtacactaaaaatttaaaaacatagttgaaataaattaaagaaggcataaataagtggtaagacattgcatggtcatgggttagaagacacaatattttttaaatggcaataatctccaccaaattgatcaacaggttcatcaaaatccctataaaaaaaatccgtggtgctttttttcacagaaattgaaaagctggttctaacatttatttatatggaaacagaaggaactcagaatagccaaaaaattttgaaaactttgaacaaagtgggaggagtcactcttcccaatttcaaagactactaaaaagctacaataataaagacagtgtggtacagcataagaatagtcatatagatcaatagaaaaaatagttttttcaacaaatggtgctgggataactggatatctatccacatgcaaaagaatgaagttgaatacctacctcatataatgtacaaaaatgaactcaaaatgaatcaaacgcctaaacgaaagggtaaactctacaaaactcttggggaagaagtatagataaatcttcatgaccttggatagggtaatggtttcttagatataacaccaaaataacaagtaacaaaagaaataaataaactgaattttgtcaaaatttaaaacttttatgcttcaaaggacatcaagaaagtaaaaagacattcacagactaggagaacgtatttaaaaatcatatatttgatatgggacttgtattcagaccatatgaagaactcataattaacaataaaaagacaaattatccaatttaaaagtgggcaaaggaataagtatttctctaaagaagatctacaaatggccaataagcacataaaaatactaaacatcattagtcattagagaaatgcaaatcaaaaccacaataagaaaccacttctcaccactaaggtgattaaaataaaaaagactaacaatagcaaaagttggcaaggatatggaaaaattggaaccttcatacattgctggtggtattgtaaaatagtgtaaccactttggaaaatagttcggcagttccttaaactgttaaatatagagttaccatatgactccaatattctacctctagttatatataacaaagaaatttgaaaacaaatgttcatacaaaaacttgcacataaatgctcatagcagcattgctcaaaatagtcaaaaagggtgaacaacccaaatgcctaccaattgatgaatggagaaacacagaattgaatattattttgtaataaaaaggaatgaagtactgatatattttactatatggataaattttgaaaacattatgctgtgatacattctacaacataaataaactttaaaaacattatgctaagtgagaaaaaaacagatagaaaaggccacatattacacgatttcatttatatggcatatgcagaatagacaaattgataaaggtgtatgccaacttagtggtagaaaaaaggaaggccaatatgggacaccgaagctaataagacatgagtaggattaaattttcagtctagtaacacatgaggaatgcctgtggcaaagcaagaccaagataaatgacataagaagacaaataaaattgcaacttcactgggaatgagatatggtagttgaatttgaagattctgccactatgtttcacaaaatatatagagagaaacatatataaatacatagacatatgaacccctgtgaaattgtgtgttgtaagaaaaagaaaaataataaaattctttaaaaaaaaactaccttgtgtttggattgtgccaaccaccacatggtaatatctgaataagtctgggtaatatgtgaatgagcatacagtttgttggcatgaacaaatattgaaatcaataagttataccagttatgaagtatttcaattctcactcctgattctgatatcagtgacagtcaatgtagtaggtttttaaattccaatctgccttaggtgttcagatccattttctggagcaggtttgaagtctgacagtccctacccggactctggttcctatgctttattatgtgcagcaagtcactgaaactgcgagatttcttcatgtataaaatcagaatgataatatgtttctcaaaagtttgtttcaagaacgaaacaaaatgtcctgtgtaaaagatctaataccacttccagaacacagtatgagctttcttttaggacagcttcattgccactgcctatgagctgaactaagcatttcatgacaagagaccctggaatataaggagtctacaaacacctacattatttagtcattcaggatgacagaacaagtgacaagagcaattgttcccaaccttagctgtgcatgtggaacatctgtgaagctttttaaatgcatataggtctgagactcacctcccaacaaccctccagcacctggtcccatgctgataacctttcttctgtataaagtcttacatagttttcacaaatactatttataaaaccctcagtgttttcttcttctggctaaaagtgcctgctgttttaactcttccactgcaaaacactgtctaattattggattattcttaaaactcatctgtgagccctggctacattatctgactgtctctttggttatgtggcttcatttatcattggtcgaacttactggaagtgaaaaggaaggttaccttaattgatagagctattgatataattctaagatatgattaattgcacaggacattttaattatatgatccgttcttcatgagacaacaaaaaccaaggcattctagacacccatgagggagctctatttctatgtctgaaaacgaaattagacttcttgcttttatttttcccttcccaaatgacatttatataacacacttaagttctgatggagtatggcaaatgtatttaactttcgaccaatatttatagaatcctttatttcataagggataaaagcaagcccagaatttttcctgtcttttaactcttgaaattgtcccctaagaatataaacaaactaaaaggcgaagcaaaacatagacaatatccccttgaatgattcataataaccacatttaagcctctctgggttttgtttgtttgtttaggtcacagcactattgggaggcaaaggggttattggctattgaagtgtttgctgttgatgaagaactaaatttaaggcatgtattcttttcttgactagagtttgattagcttcgtcatacttttgctttagggaaagaatggtatagaagaaataaaagaactaacggaagcccttccatttcaatcactgtaaagaatttatcatcataagatcaacaaagcaccatttccatgtaccttttgcaatatatatatacacacacatatatatatattttacacatatataaattatatatatatatatataaaattattgcatcggggcttctttgttgcttttctttttcctcaatgacattgagactttacctatatccaataacatttgccttcctttctattttcttgcatgttttaatctcatagtgtcacatgggttcactttacctaaagatggaatattctcctccgttggagaagaaccccaaattaggccagaagaatactgaaaaatgtatggactttgtagtcagaacctgggaagaaaaatcctaactctgccagatgaaatggtccaagtcaagttgaatggaaggattaaaatagaagattaataaaatgcagctgtagacagctggcacatagtgacagtcaataagtgacaatttataattcattcatttattctacctgcctggagaagtgaaatctaagagaaatagacaatagaaataaaatacaaatctatcaaataaaacaaagtgaattaatcagtaagcattcttgaacactaatatatataaggaagggctaacttaagaaagacatgcttttcaagagtttataaactggcttaccattttaagacattttccataaaaattatgccacatcatataaattagtaaaactctattccaatcttaacctacttgtactctatgttctagtcactctagaagtcctaatcacatgccaaaccatgccacaagtttccagggacacatttcacatatctgctgctctcagtagagggatcaataattcttccctactgggctgcagagcgaagaaaatgggatctctgataagtacaggcaatcaatccatgctggtgtccactgcagaatttaggaactccatgaaatcaggagtaagggaaggctagaccaccctctgaaaactgaacgttaagggttctactttatgcatgataaatacatagagcaaagtgaaagaaatcagatggagtctggtcagaacgaatggaagggaaaaatagttaactataacaggattgtgagatggtctagttctagtaaggggaaaggagctcagtaaggttggagaagtaggcatcaattagttccagggtacatgcagtgtagcaggttgggataaactccaacaacaaggagaactgattattttagcaagaggaaacaagacatctctgacaggggcagggggaggatgaataaacaagaggatgagtgtctggattaggctgagatccctacagcagtgggacactgggtggactctggggggaaatctgtggtaaaattcccagtaagtgtggccttggggagaaaaagagagggaaattccaagaacaaagtacttgggttttggagtcagaccagggtttgcatctgagtttgcccctttactttctagatcttagacttgaagcaagtcacctaaccagtaaataatttcttaatcacacaactttgtacaataatgcctacatcaaaggactcttctgaggattaggagataacatgtgggaaatgcctggtattgttcagatatactttgtttttattttcttttattttggtataaaatataagttcttactataagaagtttatctttctgatcaggagagatgatccaacccctaattcataaaaaagaaacaggaggaatataggaacttaaacacccaggggtgttatgaggcaccagccctagaaagaagttggaggctgaaattttagccccaactctaaagcaaagcaataatattgtctgggagctgaatccacccaaagtgaggtgcccttttctaatcctttcaaaggctctatatgggataatgggtgatcctgaaagtgtctccctaggaggtagaatacaaactactcaactgagtggcaaaacctttcatgttcaacatatgtaacatttcagtcttaaatgttttctgaattgaaccgagcattattcaggaagtgaaacactcccatgtcttgggaatacattgttcaaatagtctaaaacatcaggtatgttttattttctttttcacattataactccctgaattatattccaaaggtagaagagtttatgctagatttttacagaggatgtcttcatgcaaaattaagggattgcagactacaaaactgttggcagaagattcgggttgtttttgaggaataaatgtatgcccttccctgatgctgtcttatatggcaataaactaaataaaaattgtagttgattgacagtaattataaacctgcaacagcaataaaatttgtgttaattatcaaaaatatcagaccagttgtgctgcccattacagaacaatattgaattttctgttaaggaaattggtccacctttccctaatttttgttttgccttcctaaaggtaagcctgaaatatataatagcatatcatcagaattcattccactgactccactaaatgacttccagaaattttgctataggttgctaactaaagacagcagcatctccttgcatggaatatcagattcaaatttctttgcctgattctgggtggctctctaccaaatggccctttcccttttcctgttaactgttttgctttctaatccccaacagtttagcacattaggtgctcaataagtatctgtggaaagaaagaaggaagaaatagagagatgggcaggactatgaatgtttttttaaagacaatagaaatccccccaccaccattctacaaaataccttttgcatctgacaaatataggtaatgttattattaataatatattatttcagatattaacttctttaaaaatgtaaatcttcttggagaatcaacatttagtaatgtaatttactcatccatgccacactaagaagaaattttgaagccagaaaaagagagggtagtagaaatttgaaaaagaaaaacaataagaaaaggagaactctggaaaagatagtgctctttgcctttgtttttgctaaatatattcattcctttgatgaaccattaaaaaattattagctcctatatatcttagggatacagacattcagtcattagaagttgcgaagatcatcattccacaaatattactgggttcctgctatatgccaggtgcataagtgtagggaacaagattgcctacccagaattatgaaaccaaaatagataattacaactatgattaatgcaataatggagaactgccatggggacataacatataacaaaaaggcatactagtggggaactggaggtgggggtgactagcaatttacctatatcttttttccaaaatgatcttcaaactagaaatataagatcagttaacataaagaagaaaccgaaactctagataggtcatacaatagttagagagcatcaacccatgtgaacagtcaagtctccagtccaggtatactatacctcagggcactaaaggaacatacatattgattactgtaaataacttctgtaattctttagaaatcacagtaagcgtgatggcagaagactggagatgggtaaatctttaatccaattttcaaaatagaagttgaggcaaaagactaggaagtttaagatcagtccctgccaaaattcttagagttaagcagatggtttttgaagtcttagtaaataaactggtattcatgaaaaccaacagaatttgctaaattaagttatgctaagatgaatttattttattcttcttcattctctttcttccttcttctctccctcactcttttctttctatctttcataatttctgttattcaacaagtgcttgtccaacactttcatgaatgctttacatggaatgcttgacaagcaagctgttaaccaaaccagtggtttgcttagtaatagcaattagatattgcttagtaatagcaattagataaaaactaatttgcctaaggaacatgcattctatagtcaatgcatgaactaacctagttcagtgaatgtaagataaagaagatcctgttagcccaacattttgtaaactcccgccattccacagaccctggtcacagtggaaaattccactaaggcttgggctgtgaaaaacatcctgctggataagtcccaggcctaactgcctaactgcagaaaattcctcccttttcagcagctaacctcactgtccaccccatttcacaacaagcccagacccctcccgctcggacctataattactccagcatgcaaatggcagcgggctccagcgctagctggtatccccttctgcaggtcttttgtccaataaacctgtgttgttgttgagccagcaactctctctctcttttaccctcgccttcccttcaaagcctaacagatccctagtggtttcatggtgctctctatctatcttgagtgctctctatcttgagtttccagtgtaacatttctctcagtgtcttgataaagtcctaagaatcacagacatgttgtttacataaagcatagaaacataactagcacttgtgtcaaaatcataagggctgcttgctcaaaattcaaattcctacctatcccacagatatatttagtcaaaatttccaatcaagcgcggtggcttaggcctgtaatcccaacactctgggaggctgaggcaggcagatcaattgaggtcaggagttcaagaccagcttggccaacatggtgaaactccgtctctactaaaaatatacaagttagctgggcatggtggctggcacctgtaatcccaggtacttgggagactgaggcaggagaatcgcttgaacccgggaggtggaggttgcagttagccatgtttgggccactgcactccagcctgggtgacagagtgaaactctatctcaaaaaaaaaaaaaaattgaagtttgaagttatgtagaaatttttatttttaacaatcaccacagttatttattttgcacacttaggtctaagaaccctcactgaaatgtttaagacacattacctacccacaatcactaactaaccccatgtgtatagggggcctaattaaaatacaacaacaactataaagcttctgtagataaatgctaaaagatctcaaagatttgagggatcttccttatcctgcaatcccttttggtcttgctgcttatccttgattatcttcctctgctgcattcttttctttgatcattaatttaagtgttatgctctaatttgtttttaatttggatgacccctctgtcctaaggatgtgttttggtaaaaccctggcatcctactaccagctctacttagactccataattaaccctacacaatccctgacctctatgtcccagcctcctggaagcacctgacaacaaatatggaatcaagaaattgtgatagcactttcagtagtgtaaacaaaacacctaaaacacagagtctctgatgaattatctaattttatttctcaccgtttctactcccacttctatcatcaattccagccacataaaataatttttagctcctcaaatacatcatcatactcagcaatatcatatcatacaataaatcttttctgaaaactgccccaagtcccttccccacacctccatctaatttctagctatgtctctttagggctttctaactgtctccatcaaagcacttttcacattgaactatggaactatgatctccactaaaaggtaagccgctttatggcaggaaccataacctaacagtgtcagattcttaggatatgtttactatgagttggaaggaaaggagaggagaggggaggggaggggaggggaggggaggggaggggaggggagaggaagaatactctggagcacacaggtgggaatatctgggaggagcagaaaagacttcagaaaagagatgacatttgagctatgtcttagagtggcagagaaactaaagtgagaaggcagacatttctcttcatcacaatggccaataatcttttttgagacacaaaaatctctggcatgaattagtgtaacagttccctactaggtgtcactatatccaatatttactgtctcctagccattttccacagttcagcctagtggtctcactaaaatgaaaatctgagtatgtcctgactcttaatgtaggttgcaagattgtttataatctgactcctgcttgcctctccagatttaagggccacctccccccaccacacacacacatctgaaacactgttccaatcatatatgtacagttcctagcatgtgccaagcttgtccttttacctctgggcctatgtaccaagaacactgttccttttatttctgcctggatgatccctagtgctcctttaggactcagtttctacatcagttcctgtaggactcagttttttttatctttccttgtgaatgactaggtcaaatcacctatcacacattcttgcagaatcctacactgatcacaattataatgaaatgattgtgaaatacttgtcttccaaaaaagattacgagttccaagaaaacaggcagttggtctttttcttattgtctcctcaatgtctatcatggtgtctggcacaaagaaaatgttcaataaatatttgttggcttaatgaccaaactgaagtaaatgaatagacaaatgtttttatttccaattagattttaagcaaaatgagggcaagtttcatgtctgtcttgttcatcattgtattcccactgtctagcacagtgtctgacacataaaactctcactaaatagttgtaaaataatgaataaatgacagatcaaatgaacatggcatcctgccacattgcattactaaatgctctatgataaacacattttatctttctaaagttatattatggctgggaattaaattataaaacaatgattatcaaaaatcatagatataaacaataacatggctgtccctcagtatccatgggggattgattccaagacaccactgccccagtcccacgaataccaaaattcacaaatgtgcaagtccctatagaaaatggtgttgtatttacatataacctatgaacatgctcacgtatactttaaatcatctctagattatctataataactaatacaatgtaaatgccatgtaactagttgttatactatattgtttagggaataattatgagaaaaaagtctgtacatgttcaggacagacacaaccatctatttttttccaaatgttttccacccatggttgatgaatccatgaatgcagaacccacggacacagagagctgactttatatcacaaaaaagcttcaacagctgtaaacatttgtcatcatttaaagttataaaaattaggctctatatccaataaaacattcatgcatatatttttcacaatagttggagcttcaatgtaaaataaagcctctgtaggccacataaatttttactagctaaacgaagtatactaggtataaaaataatcaacaaaaatttagcaaggctttctagaatttagaagttcttttaaggaaaattaggatagccctcatcattaaacccggttggggtttgttaatattttccttaaatgaaagttgatattattcaatgcagtaaccaaatatctgaacatctcatttaaggtccttagatgagaggatttggaagactggaatcatcattattaatactgttgctatggatgcttttttcctaagctctttgactttatttgaagtagaccaagaatattagatcaaggggccagatggtaaatatcttaggctttgctggccatatgctgtctgtttctactactcaactctactgattcagcatgaaagcagtcatagacaatatataacagaattaatgtggctgtattccaataaaactttacttacacaaacaagcagcagcagtttgttctgcaggccagtttgcagattactcttaagtaaacaattgctgttttaactgcctagcattcattgacaattcatttgctaaaggcaccttgatttttatttgcgggatcatctctcctcctctccaaacccttgtagttgcagtggaattgacccgaggcctttagggccagaattagtcaggtggccgaagactgtccaattagaatgtctttacgttagcttcagtgactggttcaaggttgaacaaatgaaccacgatggtctactgtgtctcaatcctgggactttttggacaattgagaaacattttttatggtggggtcacaatgtaagtcttcagctgctagtagaaaccatgtagagaaaaactgcctgtgggtgatgccaacacagaagaaagcaaagcccagatatgaagagaaagagagagaccaaatccagaagggctcatctaagcaatacaacctagctgtgcctaaagacacatctcagcctacagccaaaagagatccaaattcaactgcatggataacatcaagaaaactcttaaagaagaaaagtaacccaattgagaagtctatgagatactgtggaaggtacagttatatatctctgagccagtgcagaagagtgagaggaataaggaaggatagatagccatggaatggatatgagtcagggattttttaaaccatgaaatgctgaaacagtctttctctcccacgttagtatctaaagagtctgtaattacagaacctacaaattgctccacaaacttgggggtaaaggtggaaggtggaaaggagagtcattagctaaatcatcctgaataagaagataatatacaaaatctcccaaagcagtatttccctgtaatctactaaaggcttaaaattaagggatagggtccccactcaaacagagcttgatgttttctactgcactaaccataatccatgaagaaaagaagctcagaactttaaagagggaagcatttcaggtcactttggtccaatattggaattatttgtttttgttaacttttattttaggttcaaggttacatgtgcagttttgttatatagataatttgtgtgtcacaggggtttggagtacaaattattttgtcatccaggtagtgaacttaatatccaattggtagtttttcagttctcctcctcctcctacactccatcctcaagtatgacccagtatctgttgttcccttctttgtgtccacgtgtcctcaatgtttagcagccacatataagtaagaatatgtggtaattggttttctgttcctgtgttagtttgcttaggagaatggcctccagctccatctatgttgctgcaaaagacatgatctcaccacattttctttatccagtctaccattgataggcatttatattggttccatgtctttgctattgtgagtagtgctgcagtgaacatacacacgcataggtctttatggtagaacaatttatattcctttggatatatacccaataatggaattactgcgtgaaatggtagctccattttaagttctgggagaaattgcccaactaccgtccacaatggttgaactaatttacattcccacaagcagtatacaagcattctctgttctctgtttgctgaagttgtttatcagttctaggagcttttgggtggagactatatggttttctagatatggaatcacacaccttcaaacagaaatagttttactttttctctttttatttggatgccttttatttatttctcttgcctgattccttggctaggacttccagtacgatattgaatacaagtggtgagactgggcatccttgtcttgtttcagttctcaagggttatgcttctagcttttgtgcattcagtatgatgttggttgtgggtttgtcatagatgtctgttattattttgaggtatattccttcaatcctacattgttgagggtttttaacatgaaaggaggttgaattttatcaaaagccttttctacatctattgagatgatcatgtggtttttgtttttagttctgtttatatggcaaatcatatttatttgcgtatgttgagccaaccttgtattccaggggtaacatctacttgatcatggtagattagctttttgatgtgctgctgaatttggttttctagtattttgttaaggatttttgcatctatgttcatcaaggatattggcctgaagatttgttttttgttgtatctctgccaggttttggtatcaggatgatgctggactcacagaatgagctggagagaagtctctcctcttgaatttttttgaatattttctgtaggaatggtagcagctcttccttatacagctgatagaatgtgacagtgaatccatctgatccagggcttttcctggttggtaggcttttggttactgattcaatttcagaactcatagaattgttcaggatttcagtttcttcctggttcaatcttgggaagttgcatgtttccaggaatttatccatttcttccaggtgttctcgattgtgtatgcagaggtgttgataatagttcctgagggttttgtgtatttctgtgggggtcagtagtaatgttccctttgtcttttctggttgtgtttatttggatcttctctctttttttctttagtattccggctagtgggtctatcaaacttatttattctttcaaataagaaactcctggattcagtgattttttttgggggggagcatggcttttcatgtctcaatttcattcagttcagctttgattttggttatttcttgtcttctgctaacattggaattagtttgcttttgtttttctagttcctctaggtgtgatgttaggttattaatttgaaatctttctaacgttttgatgtgggcatttagtgctataatctttcctcttaacactgctttagctatgtcccagagattctgatatgttttatttttgttctccttagtatcaaataatttcctgatttatgatttaatttcactgtttacccaaatgtcattgaggagcaggttgtttaatttccatgtaattgtacagttttgagtgatattcttagtattggtttctatttttattgtgctgtggtcagagagtatggttggtaagatttctgttttcttgaatttgttgagaattgttttctggccgattgtgtggttgcttttagaatatgcgccatgtgcagatcagaagaatgtatattacattgttttggagtggagagttctgtagatgtctattaagtccatttagtcaagtgtcaagtttaggtcccaaatatctttgttagttttctgtctcaatggtacaacactgtaagtgagatgttcaactctctcacctcacttttgtaggtgacctgtcccttttctctagctgcctttaacattttttcttttattcaaccttgaagaatctgatcaatgtgtgtcttggggatggttgtcttacatagtatctcacagggtttctctgcatttcctgaatttgaatgtcgacctctctagtgatgttggaaacattttcatgaatgatatcctcaaatatattttccaggtttcttgctttctctccctctctttcagagatgccaatgggtcatagatttggtctcccatatttcttgaaggttttgttcatttttttaattcttttttctttatttttgtttgaattagttaattcagagtaccagtatttgagctctgagagtctttcctcagtgtgatctatttgtgctattaatacttgaaattgtatcataaaacttctgtagtgagtttttcacctctatcagatgattgtgactccttcttaaaatggccatttcctctctttcagctcctgtattattttattgtatttcttagattccttggactaggttttgactttctcctgaatcttgatgatttttgctcctattcatattctgaattctatgtctgtcatttcagccatttcagcctggttaacaaccattgctagagaactagtgtggtcattctgaatacaaagacaatctggcttttcaagttgccagagttcttgcactgattttcttatctaggcaggctgatgttcccttaatctttgaagaagccgtcttttagatgaggttttttgcttttatctctctgatgcccttgaaggtttgtagtataaggtgggttcagtcaacaggctttgtttctggaagactttagggggccaaggctcagctcagcactgctgggctgtgtgctctaactcttatgggcgtttaccatgcccccagctttgttctctgaccccttgcagttaagaacctgctgtggtggaggggccgaggtattcttagactgctagccacaacgctacaatggagagtgtaagcccaagtgcttcatcagagcaatggcagagatctgtgctcactcattcatgccagcagtgcagtggggatgcacacacatgatggggtcagtgggagtggagtggcggtattcgtatgcatgctcacattggtgaccgtagcggtggggcaggggcaaggcattggcagagatggggttgtcagagtccatgtgcacatccacgccagcagcagtgcagcaggatgcccaagcatcaggaggagcaggatagcatagtgtgctcacactggcagcagtggggcagcggggtacacacacgcatgccagcatgggatgggaggcaaggtctactcacacatgcaccagtaaagcaatgtgtgtgtgtcaaggggggaggggaggtagtggtccatgcctgagtaagtgccagcaaagcagcagtggggaggctgtagtgggtgaggttgtaggtgggttggtgtgtgtcaacaagagctggtctgctggagctctccagtagtcatgcacagactgccagtgaaggagctatgatgagatccctgaggaagcaccttggttgggcttgccaggctgcactgcaagtgtgtggccaggctggagccccaggagaggccaccagacagaggggcactcagattggactggacccatcacatgggaaagaccaccctgctctatccaggtctaacagttgcccaaaagctaaagcctcctggaggagcatggcaagccttggtgtatgggtatccctggccatgctccacttcagccattcccatgccaaaccttctgctcctacaacctatctaggcagctctccctgccagctcaagtgtctgtggggattgtggggtgtcctgctgctaggattctcaaagtccatggcaagagctggtcactccttccctgttcaactcaccccttccttaggagttgctggggaccagtaatgaatcttggtgctccgaaaccctgcgcaccgttcccagcttcctcccgcttcagcccagcaactgaatcctctctccatccactctcaatgccttctctctgaagatctgcttagagtgtaccagtcttcccaatgttcttgtttctcagtgaaagatgttcctcctagttgcatctagttggccattttggctcagatcagaaattgccattttaaaaatcagatcttcattgagacttctatcaagtcaggctcaaaggcttagatttttaaatcagtgttgattttgcacaatattttagaagcttctttctgcacattaaatcaatgtttatgtcaaatacttgttctagacctccccacatctctcaatcagtgatgaccattagttttcacataaattcaagtatttatgtacttgacaaattaacaaataatttgttaagatgatcacatagaattaatattactcgttccagttgcatggtggggaaaagaaagcagaatcaatattttctgaaaacctattttgttgcaggcattatattaacttgatgatttatagctatatccttgtataaccctcacataattcaatgaggtaggttttattttccctgttctcagaaaaagaaacaggttcagcaaaattaggtaacctgtacaaataacatagttaataacaaaagtcagatatttctgcaatactctagtgcctaacatccctggaaacaaagagaaaaatctctgtggatggtgaagataagtattgctgcttaagttttgatataaaaatcatatagaggatgcttacatgcaacagataatatccaaaaaatgcataagaaaaaaatttcctcctgagaggatttaaatctaatctttgaattaaaagtaagacctaaaataattgtagaagacaacatacaatgaggcctcggtcaagtgtttcagtacttcagaaaatgaagaattttacgtgatatagaaatatttacttgaagcaaacattttataaaacagtatgaagcattcagtaatacagctgaggtacacctggggtactaatttggttatttctaggctagaaagtggtttcatgtttaattcactgctttctgaagaggaattgatctctaattgactgtaaagttatggtgagttctagttgcttattttctttgttcctgtaatattaatttcttataatctccaagcaaaatataacattatctaatgttcacttgagtgtctgaataccacacgttacctcaatagatatgttgttttttttcacatagcccaacacatttttcttcaaagtacaatacagttttctatgattttttttaagaaaaaaaaaatccaaattcagttgcagatcctctaaaaccttatccgtatccatttctttctcttgttccctagctgtgatctttaaaataaagttgatatgcaggcataccttggagattgtgattttgatccatatcaatgaagctaatatcacaataaaataagtcacacaacttttttcatttcacccgggcatataaacattatacttacactatactatattctacttagtgtgcaatagcattatatctataaaagcaatgtacataccttaatttaaaaacattctattgctaacatgctaacaatcatctgagccttcaattagttataatctttttgctggtggagggtcttgcctcagtattgatggctgctgactattctgggtggtggttgctgaagattggggttgcaatggcaatttctttcttttttcttttttttttttttttttttttttgagacggagtctcacactctccttcaggctgtagtacagtggtgccatctcaactcactgcaagctccgcctcctgggttcacgccattctcctgcctcagcctcctgagtagctgggactacaggcgcctgccaccatgcccagctaattttttgtatttttagtagagacgggttttcaccgtgttagccaggatggtctcaatctcctgaccttgtgatccacccgcctcggcctcccaaagtgctaggattacaggtgtaagccagtgcgcccggccggcaatttcttaaaataagacaacaatgaactttgccacattaattgaatctttctttcatgaacaattcttctatagcatgtgatgctgtttgacagcattttacccagagcagaacttctttcaaaatcggagtcaatcctctcaaaccctgccactactttatcaactaagtttctgtaatattttaaatcctttgttgtcatttcaacaacattcacaggattgctgagggattgttcacaggattgatgaggcctcattgtatgttgtcttttcttctacaattattttagttcttacttttaattcaaagattagatttaaatcctctcgggaggaaatttttttcttatgcattttttggatattatctgttgcatgtaagcatcctctatatgatttttatatcaaaacttaagcagcaacgttcctcaggagttgattttgtctcaagaaaccacttttttttttgctcatccacgagaaacaattcctcatctgttcaagttttatcatgatattgcagccaatcagtcccatctacaggctccatttctaattcactcactatttctaccacatcttcagttccttcttccactgaagtcttgaacctctcaatgtcatccatgagggttggaattaacttggtctaaactcctgttaatgttaatgttgatatgttgacctcctcccatgaatcacaaatgttcttaatagcaagtagaatggtaaatcctttctagaaggttttcaatttacctttcccagatccatcaaaggaatcattatctatggcagctatagtcttacattatatatttcataaaaaagacttaacagtctaagttaatccttgatccacgggcttgcagaatagatgctgtgttcgcacacataaaaacaacactaatatccttgtacatttccatcagcaatcttgggtgactaagtgcattgtcaatgagtagtaataccttgaaataaatcttttgagcagtagttcttaacagtgagcttaaaatactcagtaaactatgccataaactgatgtgctttcatccacccaggcttgattgttccatttttagagtacaagcaaaatcaattttgcatagttcttaagggccctatgattttcagaatggtctatgagcattggcttcaacttagaatcaccagctgcattcacccctgacaaaagagtcagcctgtcctttgtagatttgaagccaggcattaacttcacacctctctagctatgaaagtcctacatggcatctttttccaatacaagactgtttaatctacattgaaaatctgttgttaatgtggccacgttactaatctgctctcatgctgctacaaagaactgcctgaggctgagtaatttataaaggaaagaggtttaattgacttacagttccacatggctggagagacctcaggaaacttacaatcatggtggaaggggaagcaaatatgtccttcttcacatggtggcaggagagtgaagtgctgagcaaagtgggaaaagcctcttataaaaccatcagatcttgtgaaaactcactcactatcatgagaagagtagcatggaggtaactgctctcatgattcaattacttcccatgaggtccctccctcaatacgtgggtattacaatttggattacaattcaagatgagatttgggtggggacacagagccagaccatatcagccacctttatcaattaccttagctagatcttctcaataactttctgcagcttctccatcaatacttgctgcttctccttacagttttgtactatggagacagtttttttcttttaacctcatgaaccaacctgctagtttcaaacttttcttccgaagcttcttcacctttctcagccttcataaaattgaagagagttaagccttgttctttattagcttttggcttaagagaatattgtggctgatttggtcttctaaccaggagaccaaaactttattcacatcagcagtaaggttttttgccttgcttatcttttgtgtgttcactgtaatagcacttttaattttcttcaagaacttttcctttgcgtttacaatttggataactgtttggcataagatgcctagctttggcctattttggctttcaatatgccttcctcactaagctgaattatttctagctttgattttaaagtgggagatgtggaactcttcctctcacttgaacacttaagagcccattgcagggctattaattggcttaatttctatattgttgtgtctcagggagtagggaggcctgaggagaggaagagaaataggggaatagctagtcggtggagcagtcagaaaacacacaacacttactaagttaactatcctataatgggcacagttgtgtcaccccaaaacaattacaatagtagtatctaagctcattgatcacagataaccataacagatataataaaatgaaaaagtttgaaataggatgaaaattaacaaaatggaacacagagcaaatgctgttggaaatatgtcaccaatagatttaatcaatgcagcattgccacaaaccttcaatttgtaaaaagactgtcattacctatgaagtgcaataaggtaaataaagtgcaataaaatgaggtatgcctggatatctttcccacccactttaaaacatttttactgtgtattttctcatagacaatatattgtactattgcatgcactttaaaattacattaatagccaaataatgtacttaccctctgccacttttgtcagtcaagatcatgtttgcaagatttctagatatagttaatgatatgttttctacattttatagttttctagatatggatatttcatcacttattcactcggttctctagagatgaaaatttggattgtacttgttttgttttggtcttgcaccattacaaacaggattgcaatcaaaacttctatgtacattgaatgaaaacttctctagagttcatacctacatgtgaaattgttgagctcacagaaatttgccaaaaggttcatacaaaaatatttactacagcactgtttacaaagctaaaaactggatacactgaaattataccaaccaatagcagaacaggtatataatttttaatatatttatgcaatgcaattaaagagaattgtatagacgcatacgtgctgatacagaaagacgcccaaaattgattgctcagtgaaaaaaaaattaagttataatactctatataaaattatcccattttttataaaaataaatgataaaattaataatatatgtacatatttagagaaaaaatagagaccaatttaagaaattcatgttaataactatgtatgatatataagataaacttgtattttctctattttaaatttcaatagtaccagatacacattacttcaatctacacttataacctgaatgaatacataatttcttcttatcctaataatgacacattttgcttttctgaccactaacatcccttacaagactaactttttccattaattcctaaccaatttctgtttttagcacaaacaataatagtctgtacttacttacactactgcaatctccttgttgctatatcttgaaatttttcaaacttgaaattaattacattcattaccactgcttttaccaggaacccttctgactctataatattctctctcagacctgaataaatatcatattattataacaaccttctaggtcaattatgggatttcaagttaaaaatatataactgtaaaatttaaagaaggtgtgcagtgagaaggaagagttgttcattctggaaaaatatatttggatacccaatcaagtttccttagaatgtcatttacttgaaaaaattaaccattatccataaatgatactcttattcttaaagaattacaaaaattaatccctgtattatttctaaattgatcagaattatgggttctaattcagtctaataaaggtcacaaataattataaatatttagtaagctgttattcattgggcactatgtgcaagaaatagaggacatagtggtaaataatatagatgagctccaagtctaaaatggcatcaactaaattaggtggggatgaggctcttcattgcaatccattaagtgcagctcctggggcacaaatccttccatatatggacccatgaaatgaaagagacaagccatccttcttcaaaccccccaacctataatggtaggataggcacagcacaacagctatagacatcacagttctaatgggggaaaatgaaaagtaaaaaggagtcacaggggtcactgtttcaaaggagttctgaaatccagggagtaaatgggagtttcttgattaggtttcaagggcagagaataatcctccttggctctcagctccattctctgaaggctccatccttcttggttctgccctctgagtcatccttcctttttcatgaaaggtaacacatgtttgtagcttagtggttttatcagactgcttcctgctggtagaattttggggacttaaccatctcctttccttttgtagtattgtctctgacctttttagatgaagctggcagtgtttctgcttcaataaatttctcaagaactttgtgggtcttccatggatttcacagggattcacaccataaaagaaaagccacatccacagatgtttttaagattgtcccttttctatatcttggcttcctgctgagagggctagaggacaatgcccttcagcctcctagaggccctcaggtttgtgtgaaaaaatcagtgaggcacacccttaatctcttgaaaagagcctttgtactgaatacgctgacattttgatctttctgatatttttagcaaaagtcacacactctcaatgccatacttttgagtatggctatttctcaatgccatacttttggcagccatttctgaattttagcatcttttgccatctggagaggctgcgaattttcagtcacgtaatcctaatccattttctttaacatgtcttccttcaacttatctctcttttgcattctattacaagcagtaagagaaaaccagtagcaacttcaatactttgcttgaaatctccttagcactacatacaagcaagttcattgcccacaagttcttctttccataagatggcagaatgcacaattttgctaatagttctgcaagtatataaaaaggatccctctccttctaatttccaataacatgctcctcacttctgagcctaacagcagtgctctcaaagttcagatttctactaagggtctgttcatggcaactcaggctgctatggtttgaatgtgtcccctaaatttcatgtgttagaaacttaatccttaaattcatgtgttgattagaggtggggtcttgggggctaattagggttagataatgtcatcagggtacagtccccatgatggaactaacggctttataagaagaggaagagagagagctctgagctgacatgcacactcttgctctcttgccttgtgatgccttctgtcatggaatgagcctcactagatgacggcaccatgctcttggacttcccagcctccataaccatgaactaaataaacatctattgcttataattttctctgtctgtggtattctgttacagcaacagaaaatggactaagacataggcttcctctatcatgttctgcaaacatttcctagcctttgtctactgtctaatcccaaagctgctcccatattttaggtatgcctcttggtaccaaaatatgcataacatcttggtggcttaaaacaacactcagtcagtttctcctgcttttcatcagtcaggagtctgggcctggctcagtcttatgctcaaagcctccaaagctgcactgaaggtattggctggactatggttctatgattctgatctagagcttggggttctctctcaggtttactcaggtcattggaagaattcagttccttgcagctgtaggactcaggccgtcagtttatataagctgcctctctccataggcagtttacaaaatgattctttgctttcttctagcccagcaggagaccatctctctttaaagggcttacctaattaggtcaagcccatccagtaaaatctaccctcaataaccttaaatccaactgactgggggccttagttacatgcaaaaagccttttatatgcttatatccctctgagtcaggaaaaaactaccagagttctcactcccccatcaagagccccccgacacacacacatacaaacacatacctaattatagataatatttttttctaaaatacatccatatggttgtgtgattttctccagtggtgctgaacaaccttggttcagaagtaaagaatcttgacactagaactaatccaagaaaagtgggtaagaaaaggtccctaaaaggttctcaacatgaagcagcaggagaaattcagaagaggaagagagatctccatcagccacttggagtagataaaggtatcaggaccaagatatgctaaagggggcagataatcatcctgtcacagaacagaaatctcaattagaaggctttcctaaaaaaatttcaaaagaccataactgctcttaccacactttacgtaaccaagaagtggtaatcagataaatctcctaggaaagagcttatcaactcaattgagactacatttatatggagagggacagaggcagccaggcacatgagtcagctcccctgcccccagcaccaccttccactgtgaggttttcagacttgacaacaaggacaatttattatttcacattgaccaaaatccagtggttaaatgagattacagtcctgttgtattagtttcttattgctgctgtaacaaattttcataatttattggcttcaaacactcacaatattttactattctctaagtcagaactatgaaaatcaaggtggactaaaagtgtcagcagggatgcattccttctaggggctctaggagaatctgttttcttgccttttccagcttctagaggagacttgcattccttgggctcatggcctcttcctctaccttcaaaagccagcagcatatcattttcaaatctctctcctactctgagatttccaccttcatcttattaggacacttgtgattatactcagcctaccttgattacccaagataatctttccatcttaaaatccttggcttactcacacctgcaaaatctcttttttacagaaggtaacattttacaaactttcaggcattaagatgtgggcatctttcaggggtctcattttggttatcacaacttccaaatacctttctaatattcaaactcaatcatttcatttgggctgatgataaaaatgctctgtaatgttttaatgagtttgcttataaagtttatctgaaatatatttctataaattcttatattctctgacaaaatcaacagaggtgttagattgaacaaatttgattagctaatagaaattgttaagtaacatcatgttcttaaggagttgcttcaaagcattcacaaagcacctaatttatccttgcaattgtcaaataagtaaaagtaggtatcataaaagaaaatttcaagtaaggaaatgaaagcacacagtggctttcctagatctcccagggagaaattctggaagaaatatgaatagaactcagcttctcttactcccattcagtagcttaaaaggctaggaataatagttacaatgattcatactgattacctagtgcctcttctccaaagtactgcaaatccacaagagaaatcatcacagacacggtgatatgtctttggttagtttttctacctcctggtttcaacaaagctttaaagaagtatagagaacatggaacaatctgtgagaaactactccacctcgagtggttccacttgaaatgtaaataggtttggaaggtcttaagtaaacatgacttgaaatttaaaaaacatatattgttaacctgactggaaggtaaaaacaaatttagaagaataatggatgtgctgtctggaggctataattactggtgctctaacacagcagtgtagcgagaggctgggaactgcttcatgaaaagtgctggggaactggacagaaattggttggaatctcaattcttctgcttatactagctgtataaccttggacaagctacctaaactctcagattcctcatcttaaaaataataatagctgtcttatagagttgatataaaaattaaaggtactacatgtaaaatacccggcacataaaagcacttaatatctttcctacttgggaaaaaactaaaatgtaggaacagactttcctgttaagaatgtttgtagtggatgctctgttgtgctgcccagattctgcttcagagaggaagagtttattctccaagcggctggaagagctgctaatggaaagctctttgttgtcagcccctacagggatcgccttagttgaagagagccttttcacccaatgtccaccccattaagaatgacttgcctccagtgactgatcaaagagcccatcatcccagatcagaacttgccatggaattggcagaggcctctgttgagccagcctgccagttcagcttctccctcggtccaatcctgcttccttcctatgacttcccttctagaggtgttgatctcaatgccctccctaataagccctccgatatcctagtcacggttgggagtcagtttaccagggaacactatccagcaacaatgttgcaggatgaactgttgctcagacttttatatagcccttaccatcaccaaccactccccacaagggcccaaaggcacataactcacccaagtatcttttggttgctctggtaaggattgaagagtaaggattcttaagccttgaaccttgcttctgctgatgtttaacaagcagctggaataagtgtgaaccctctgccccagctccatttcaccccttctcaacatctttcatctgccagcttgtataaagattcagcctgccacattagaaatgttgcttatgtcacaattgaggaaattttaatatgagctgtatagcaaatgatattaataattattaatattgttgttcttgagctttataatactccagataaaaaaaaaaaatgaaggcggataggccgggcacagtggctcacgcctgtaatcccagcactttgggaggccgaggcaggcagatcacgaggtcaggagatcaagaccatcctggttaacacggtgaaaccccgtctctactaaaaatacaaaaaattagctgggcatggtggcgggtgcctgtagtcccagctactcaggaggctgaggcaggaaaatggcgtgaacccaggaggcggggtttgcagtgagctaagattggccactgcactccagcctgagcgacggagcgagacttcgtctcaaaaaaaaaaaaaaaggcagataaatgaaacaagattggcaaaatgatgaacattgatgaagctgggtgactggtattatactattctccctatctctgtatgtttgaacttttccataataaaataatgaatattaatatactttataaaagtatatacaatgtacgtactttagagatcaattgttaaagataggtttaataatatatttaacttcaagttggcttatgttaagcaaataaatcaaaatatagaaaattcatattctccaaagcaaataaaatggggcttgttaggcatcttgccaaatagttccgaaatttattttttttaagtgctgagactttctttaaaagaaaactccataaggcacttcaaactaaatttttatgttaaaagatttattttacatattaaagtacagcatacaggtattttgttcattatacagacttttagattatgaagactttatatgtaatagcatattatcccaatttttaaaagctcaattttctagatgtcttttttgataacaatgcatgtgatttaccataacatgtgtataaaatctagccaaaccacaccattcttcctccacaacccttaaagaagatcctatagactcaacaactgtgccacctaaggctatgtaaactttggtcaaacaactctgttgtatacacaaatatagctatatctacaggtatagatagagagatataatatatattatttatacataatgattaagaattaagaattaggtcaaaaatcacaacaagaaaaaaaaaagtagtatctgattcaggtattcagtctgtgtagagtggtactatttttgccaatcctcaaatgtttacttcaagtctgctatgatgagaaaacccagaaggcctaaatatataacacaaacatgtttcccatctttgtatccttctatgtttgaagatctttccgaatgttaaggtctcatccatttaaggtgatttgatccagaacattggggaatactattattcagaaaatgattcttcttaaagggacttgattatttcaatgatcatagagctgctctaagggatttctatagccaagtcattattatatccaggtacttttcatataaataagggttcaagcatctgaaacaaaaaagaaggaaatgaagtgttctaaggacaaagacaaatggtgtgagttaggagctggtctaacagcatataaagcctgaattttccaaagtattttacctgactctctggactaccccccaaataaacaaacaaacaaaccaataaaatccaaatatgtataaaacatatgcatgttgagcctagtcctataggaaacatgacaggtttgagaagaatttgatgcaaaataaaatgggatgagatgtgataacgatcaggaaaattaggatctagtactagatgtgcactaactaagctctatgaccctgggcacttcacatcttggctctcagtttgtctctctgtaagatggaggtcccttacagctattatattccaagattaagaatcaagtatgatactttcaatattaataagtaaccataaaaattttaagcaattggattaataccatcttgaattgaaataaaacaataaaaaatttaaaatttttttctaaaagttgaaaataaatgttttttattatatgagtttaggtttccaaatatgtttttctcccatactacattttcctatagctttgtgaaataatatgagattaatcttatgccaggcagtccagtgggtgctctgcaaacttggctctagaggaacttgataattcagatataagccatgcaattttatatttcaaatcaaaactatctaatgtataattaagttaaaattcaacagttacagtctagaatagccatcaattcagttttaaacacagtgtataaaattttaagtcctgcattttaggtacttgtgggctattcagcagggaaactactttaggctagtgagataaatataaaatttcatgttgtaatataattttgaggcagcattaaatgggtaaaattcaggtagtaagcctaaaaatccaagataactatagagataaataattatttttgtaaattataataattcccatatctgtgataataatagcaactacagatttgtataaggctttaatttatacaaataaatctgtttcaattattacaaatgtaatacaagatacatataatatgtatcgtgtttacattcttacggtatattttgaatgtgttacatcatttaagtaataacataatttaggcattattatctttattcattattatcatctccattttatggatatggaaattgatcaaataaaactttaaagagcaaacaggctgcctgaactggatggagagatcatggtgctaaccacatcaaggttagttgttaagtttctcatcctagtggagtctcagtcagataatcataatagaaatggaaaatgtatttaggccacaaacagattttcagcatctattgatttactaatatagctttttgttccttaatttattgatgcagtgaattactttgattgagttgctgctgtttaaccacctttctattcctggagtagattctactaggttatagatattatccacttattaaattgctgtactctcttataaaaatatctagacatacattgacatatgagatgattgatttttttaaaaaattggtattatcttaattggatttagggatcagcattatattagcttcaaaaaatgaatgttttatctttttctattgccaggaataatttagaatttatagtgatactcacacaccatgatcactttcttttctctctttattgtatgtatctgaaaaatcctaaccatggctaaatctaattccctgcctattcagagcagcttaacatggttgggggaaaattaagtttcctactctttatgatgactatttcagaccttctttcttctccagcacacaatgccccacatcactctcaatcaataatcattattatttcactgaaaaaataaaatagaaaaaaaatcctcactcttccagcagtaaatcagaaaatctacttgtatcaggatgtatatactctcatttcactccttggcaataaatgaactgtccatgttcctctagtgaagtcaatacgtccacctattcactgggtctaaactttgccttatcaggacttcgctactcaaaaaaaaaattttttttaatttctcttttttatcatttttttcacttgctacttgtaagagatattccagtctgcctttcagatttctcctcaagatagtcactaatttcccccaaatgccagaagtgttgcctacagaggtttacaggaattgccttgaccaacatgacaccacacatccagtgttttgtcagtgggtttattcaattccatggcctcagttgagttttctcttaagggtcatctcagtttcagaggtacataaagaatccaatgaaatctctgttacagttacatcacagttcaacttcttttgttccaccttattcctttcactcctttactgtattgttcccgagagcacttcccaataaatcacctacacgtaaatcttagttgtagagtcttttttttctgggaaacctaagctacaaaagttgttgccagggaattggataaaatcttcaatagtaagacattcagtagagaggataaattagtcctacacaacaggctgctatggaatcatcttagcaaagctaaaaagccattgttatacagataccaaaatcagacagactttaatgaaaacaacaggccaatatctttcatgaatatatacacaaaaatcctaaacaaatattagcaaataaagctcagcaatatgaaaggaggataatgcattatgaccaagtgaggtttatccctgggaatgcaaggttgagttaacatttgaaatcaatcaatgaagttcctcgtattaaaaaaaaaagaaaccctataatcatcttcatagatgtggaaaaggcatttgacaaaatttaatatatattcatgatgaaaaactctcagcatctgaggaaaagggaaactttctcaacctgataaagggcatctatggaaaccttacaattaacaggacaatgatgaaaagctgaatgttttcctcctaagattgagaaaaagcaagaatgcctactttcaaaattccatttaccatcgtgccagaggttctagccagtacagtgaggcaaactaaacagataagaagtatacacatcagaaagaaagcaataaaattatctttattgacagacattattatcacctacatacgaaatactacagaactttaaaagctactaaaactaataagtgattataccaaatttgcaacatacaaggtcaatatatatcagtaaaccattggacagatcctccaaagtcttaaaggcagccagagagaagaggcatgtcaaatgcaagggaactccatcaggctaacagtggtcattttagcagaaaccttacaagtcagagaggttggggacctatagtcagcatccttaaagaaaagcaattccaaccaagaatttcgtatccatacaaactaaacttcatacgtgaaggagaaatatgatcctttccagacaagcaaatgataagggaattcttaccaccacgcctgccttacaaaatgtccttaagggagtgctaaacatggacatgaaaaagcagtactgtattagtctgttttcacactgctaataaagacatacccaagactgggtaatttataaaggaaagaggtttaattgactcatggatccacatggctggggaggcctcacaattatggtggaagaacaagggatgtcttatatggcagcaggcaagagaaaataagagccaagtgaaaggggaaaccccttatcaaatcatcagatctcgtgagacttattcactaccacgagaacagtatggggaaaaacacccccatgattcagttatctcccactgggtccctcccacaacacatgggaattatgggagctacagttcaagatgagatttgggtggggacacccaaaccatatcaagtactttccaccaaaaaaatacactcaagtacaaggccactgaaactataaagcaactatataataaagtctacataacaaccaggtaaaaacacaatgacaggatcaaacacacacacatcaatactaaccttgaatgcaaacaggctaaatgccccaattcaaaggcacacagtgacaagttgggtaaataagtaagacccagctatgtgttgttaagagacccatctcacatgcaatgacaccgataggctcaaaataaagggacggagaaatatctatcaagcaaacagaaaacacaaaagggcagaggttgctattcttatttgagacaaaacagattttaaaccaacaatgatcaaaagggacaaagaatggcattacataatgagaaagggttcaattcaacaagaatacttaactgtcctagatatataggcacccaacaccagagaacccagacttataaaacaaattattacagacctacaatgatacttagataaccacacaataatagtggaagacttcaacaccccactagatcattgagacaaaaaattaacaagatattcaggacctcaactcaacacttgaccaaatggacctaacagacatctctagaatacttcacccaacaacacaagaatatacattcttctcatctacacagcacatactctaagatcaaacacacacttggctgtaaagcaattctcagcaaattcaaagaaaccaaaatcataccaatcacactcttggaccacagcacagtaaaaatagaaatcaataacaagaagatctctcaagaccacacaattacatggaaattaaacaagctgcttctgaatgacttttgagtaaaagacaaaattaaggcagaaatttaaaaattctttgaaactaatgaaaacaaagatacagcatgccagaatctctgagacacagctaaagtagttttaagaggacaggtttttctttttttcaagttttattttagatttagtggatacatgtgtgtgcttgttacctaggtatattgggtgatgctgaggtttggagtataaatgatcccaccatccaggtactgagcatagtacccaatacttagtttttcaactctcactcccctcactatctcttccatctagtagaccctagtgtctactgttgacataagatgaaagtttatagcactagaaacctacattaagaagttaaaaatgtctcaaattaacaaccaaacattgcacctagaggaactaaaaaaataaaagtaatacatgcaggaattttgtagaggggagtttaaaaaagcagcagaaaataattaccctgaatctcaagacctagaaatactgatattgttttgatatatttccatccagtctttctctgagttttttttacccagttaagattatactgtgtacatgcaattttctgtcctgctatttcacttaacaaatgtcttaaacatttctccttgtcattaaaaactctctgttcacatcaaataaataaataaataaataaataaataaataaataaataaaagcaaaccaaccccgatgctagcagaagaaaaaaaataaacaacatgacagctgaactaaacaaaactgagatgtaaaaatccatactaaagatcaacaagaccaaaactttgttgaaaaaataaataagatcaatagactgctggatagattaattaaaaaagagagagaagatccaaataaaaacaatcagaaatgacaaaagggatattaccaccagccccacataaatacaaaaaaaccctcagagacaattataaacacttctatgcacagaaactagaagaaatgtataaattcctggaaacatacaacctcccaagactgaaccaggaggaaactgaaacactgaacacatctataaggagttccaaaactgaatctgtaataataaaaataataaaccctaccaacagaaaaagccctggaccagatggatccaccgctgaattctactgcatgtataaaaagctggaaaccattactattaaaattattcaaaaagaattaaggaggagggactccttcctatctcatcctataaggccagcaccattttgaaaccaaaacctgacagagacgcaagagaaaactacaggccaatatctctgatgaacatagatgtaaaagtcccaaactaaatattagcaaaccaaatccagctgtgatcaaaaagttaattcaccccaatcaagtaggcttcattcctgggatgcaaggttagttcaatatgcacaaatcaataaatgtgattcaccacaaacagaagtaaaaataaaaccatatgattttgtcaatagacatggaaaaagtctttgataaaatccaacatcccttcatgataaaaaccctcaacaaattagatatcaaatgaacatacctcaaaacaacaagagtcatctatgacaaacccacagccaacatcatgtcaaatgggcaaaagctggaagcattccccatgagaaatgactgcacacccactaaccactcctatttataacagcactaaaggtcctagccagagcaatcaggcaagagaaagaaataaaagacatccaaataaaaggagaggaagtcaaactatttgtctttgcagattatgattctacacttagaaaaccccacagtctctgcccaaaagctcctagaataaacaacttcagcaaagtttcagaatacaaaatttattacaaaaatgaatagcatttctatacaccaataatccaagctgagagacaaatcaagaatgcaatcccaatcacaacagccacaaaaagaataaaatgcctaggaatacaggtaaccagggaggtgaaagatcactacaattagaattacaaacactgctgaaagaaatgagagacaacataaacatatggaaaaacattccatgctcatggataggaagaatcaatatcattaaaatggccatgctgcccatagcaatttacagattcagtgatattcctgtgaaactaccaacatcatttttcacaaaattagaaaaaaatgattctaagatttatctggaaccaaaaatgaagtcaaatagccaaaacaatcctaaacaaaaagaacaatgccagtgacatacattacctgactttaaactatactacaagtctagagtaaccaaaacagcatggtactggttcaaaaacatatacacagaccaacggaacagattaaaaaacccagaaataaagctgcacacctaaaaccaactgatcttcaaaaaagttgacaataacaagcaatggggaaaggacaccctattctataaattgtgctggaatagctgactacccatatgcagaagattgaaactggatcccttcctttcactatatacaaaagtcaactcgagttggattaaacacttaaatataagacttaaaatgtttaaaactttagaagaaaacctgggacgtatcattttggacataggtctgggcaaagacttcacgatgaagtctccaaaagcaatggaaacaaaaacaatcaaagataagtgggatctaattaaactaaagagcttctacacagccaaagacactattcaacagagtacacagacaatctacagaatgggagaaaatatttgcaaactatgcatccatcaaaggcctaatagctagaatctataagaaacataacaaaatcaacaacaaaaacaaataaccccattaaaaagtgggtaaaggacatgaacagacacttccaaaaaggagacatacatgtagccaacaatcacatgaaagaatgcttagcaacactaatcatcagagaaatgcaaatcaaaaccacactgaaatacaacctcatatcagtcagaatgactattattaaaaaggcaaaaaatgacagatgcttgcaaagttacagagaaaagggaatgctcatactttattggttggcatgtaaattagtccacccatagcagaaagcagtctggaaatttctcaaagaatttaagtcagaactaccattcaatccagcaatcctattactggatatatactgaaaggaaaataaatcgttccaccaaaaaaaaatgtacactcatatgttcattgcagcactattcacaacagcaaagacatgaaatcaacctaaatgcccatcaatggaggactggataaagaaaatgtggtatacacaccattgaatactatgcagccataaaaaggaatgaaattatgtcctttgcatcaacatggatgcagctagaaaccattattctaagcaaattaacataggaacagaaaaccaaataccacatattgtcacttataagtgacagctaaacactgagtacacatagacacaaagcagggaacaaacactggggcctacttgagggtagagggttggaggactgtgagggttgaaaaattacctaccaggtactatgctcactacctgggtgacaaaatcatttgtacaccaaacaccagcaacacacaatttacccatgtaacaaacctgcacatgcacccctgaacctaaaagttgaaagagaaaaaaaattaaaaattaaaattaataaaatcatttataatatgttcaaaaatatgacctattagggataaatataatgacagaacattgctcaaagaaatttgaaactggagaacattatgttatgtgaaataagccaggcatagaaagacaaatattgcatgtatttactcatatgttggagctaataaaaatgatctcataggggtagaatggtggctaccagaggttgggaagggtagcgaagcgggggatggtgaagagaaattggttaatgggtaaaaaaatatggttagacctaaggaataagttctattgttcaatagcacagtaggatcactatagttaatgataatttattgtatatttcaaaatagctagaagatttaaaatgttcccaatacatagaaatgatcaatatttgaggtaatgaatatcccagttaactggatttgataattacctggtgtttgcatgtaccaatgtgccacatgtaccccacaaatatgtacaatcattatgtgccaatttaaataaaaatcaagtcctaaattaaggtagctatgcatgatgttcatggatagaaaattcattatttataagatgccaattctttccaaattgacctatatattcagtgcaatcacagtaaataccccaggatttctataatttctatatattatagaaattgatgggctgattctaagataaataaggaaacgcaaagtacctagaacaaccagaacaatttgacaaagaacaatattgggaaattaacactatttgatttcaagacttaatacaaaagtagagtgatcaaaactgcatgggttttgacataagaataggcacagagatcagtggaataaaataagagtgtccagaaataaactcaccagatgtgaccatttgattttctacagtgacaccaaggtaattaaataggaaaataatgaaattttcaacaaatggcacagaaacatttggatatccaaatacaaaggaaatgaacctcaaaccttacaccatatataaaaaagtaacttaaaatgtaaaatagacttaaatgtaggccctaaactaaaatttctaaagaaaaatatagggtaaaatctttgtaactttggcttgggtacagatgtctctgaatacttaaagcacaaatcataaaataaaagactgataatttgaaaatcaccaaaataaaacatcatttcttcaaaacacactgttaagaaaatgaaaagtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtcaacccgggaagcggagcttgcagtgagccgagattgcgccactgcagtccgcagtccagcctgggcgacagagcgagactccgtctcaaaaaaaaaaaaaaaaaagaaaaaagaaaatgaaaagtcaagccataaacttggattaaacatacatctgataaaacacttgtatcaaaacacataaagaattcttacaactcaataataagactaactggtttttgtttaatcattgaaagatataaagatactttataaaagaatatatatgaatggcaaataataagcacaaaaaagatgcttaacatcattgatcattagggaaatgcaaataacataccagaacatactctttagaatggccaataataagaatatgaacaataccaagtgatggaaattattgaatcaaccagaactctcagacattcctgatgggaatgcaaaatggcttagccattttggaaaacaattcagcagtttcttttaaacatatatttaccataagactatgtaatcccacatctaggtattttttaaaaaaaaaagacagagatgaaaacatttgtccacacaaagacttgtacttgaatgttcaaagcaacttttttcataatagccaaaaaacaatcaaatgttcatcgactgatcaatctaaaaacaaactgttcaatatccataaaaaataatgctactcagcaatgaaagggacagacaactaatatgtggatgaacctgaaaacattatgctatgtgaatgaattcaggacacaaaagaatgcatagtatctggttctattagtatgtaaatgaagacaacgcaatactatgtgatctgtgaaagcaaacagatcaaagattgcttaagtcaagataatgaggggattgattgcaaaggtaaataagggaatgtttttaagatgacaggaatgctctaaatcttaaggcaaatctttgacagttatcaaacctcatcaaattgtataactacaattcatgaatttcattgtatgtaaatgacatgtcaataaaaaaaatcaaaagtatcagacaccaaaataaatattcaaaatttatttttggaaaagtgttgatggctatattttacaaaatatttcaccctctattttcctgaaatacctgtccccctttggtgtacttatattatttgatttacatgaagctttgtaggaacacctctaaatctagatatgagaaatgcttattgtaccactatctaaaattgtgttttgtcacaaaccaagtgctttaagatctaaagatggtgaaggatacaacacatacagtctaccctggaagactatgtcattggtttttttgttgcacatacagtacactctattgctttgggatcaccaaaattaatcacttcaactaaaggtacatgttggtttttctccattccaagagagtaacaacacaactgattattcttagtgtgtgagctgagtaatgaaaaacctacagaaacatgaatataaatggaagtatataaactgtcatttcttaaaagtaggtcttcaggatagaatggggaaggaagaattacaataattaattgtaaacatttaagattctcagtgtgctaggtactgtgcataatgcagtggctataaattaatgaatggtactgatttgaaccacattatacctatttttctttatatttccaacaaatgactaacactattttatgatcagttctttttccactggaattactccattaataaatgactttttagatcaaatggctgtgaagtaagttaaaaaatatgaaaatcatatataagcaaagataaattcagggtgcttcttttttttcaattaatgccaaattatttttcaggatatgcagcattttataaaattcctaggcaagttaaagcacagatcaacaaatatttatgaaactcccatattctacaacactatattccatatggtaggataagcaacagaaacagtgtgggatccaaaggactttaattttaattgaggaactaaaacacaggtacatagattcgcatatatgttattaatgccatttcttcacagcaatactggcacatgcctgctcccttaaattactttgcctattcaaaattacctgtcaatgttagagttggcctcttgaggcccatttttctgaaaaaatgaagtgtatcattctgctcttaaacagagactctagagcccctttttcctttttcacaacagggttcattttagaaaatgtgtagctgccagatatgacaatgtaaaaaggtaggcagagaaggagataaacacagaaagaacagaaaggtgaattaggcatttaacaatttattcagaaaaatgtgccagcacctcaattttataaagtcatgggcaaaagcttatgaaaattgatttagcaaaacaaagcccagggaaatacaataatgcatttccaacttcacatggcttttatgtgaaattcttctatattaaaacatactataggccaggcaccatggctcacatctgtaattccaggactttgtgaagccgaggagggaggactgcttgagcccaggagtttgagatgagcctggtcaacatggtgaaactccgtctcaatgaaaaatacaaaaattagtgggtgtgatgctgcatgcctgtagtcccaactactgggaggctgagttaaaggattgtttgagcccaggagaccgaggctgcagcgagctgtgactgcatcactgtactccagcctgggtgacacagcaagatcctgttttgagagagaaatatatatatatatctgttctcacgctgctaattaagatatacccatttataaaggaaagaggtctaattgactcacagttccacaggggtgtggaggtctcacaatcatggcagaaggtgaatgaggagcaaagtcacatcttatgtggcagcaggcaacagaacatgagcaggggaactgccctttataaaaccaacagatcgcgtgagacttattcactatcatgagaatggcacaggaaaaacctgctcccatgattcaattaccttccactgggtccctcccatgacacatggggattatgggagctacaattcaagatgagatttgggtgaggactcagccaaactacatcatccaaactatatcatccccccggcccctcccaaatctcatgttctcgcatttcaaaacacagtcatgcctttccaacagtgcctcaatatcttaactcattccagcattaactcaaaagtccacagtccaaagtctcatctgagaaaaggcaagtcctttctgcctataatcctgtaaaatcaaaagtaagttagttacttcctagatacaatggaggtccaggcattgggtaaatacacccattccaaatgggagaaattggccaaaatgaagggactacgggccccaggcaagtccaaaatccagcagggcagtaaaattttaaagctccaaaatgatctcctttgacgccatgtctcacatccagggtacactgatgtaagaggcaggctcccatggccttggacagctccgcccctgtggttttgcagggtacagcccccctcccggctactttcacaggccagcattgagtatctgtgacttttccaggcacacagtgcaacctgtcagtggctctaccttctggggtctggagaacggtggccctcttcttacagctccactaggcagtgccccagtgcggactctgtgtgggagctccaaccccacatttcccctccacactgccctagcagaggttctctttgagagccttgtgcctgcagcaaacttctgcctggacatccagaagtttccatacatcctccaaaatctatgtgaaagttcccaaacctcaattcttgtcttgtgtacactgacaggaccaacaccacgtggaagttgccaatgcttggggcttgcatcctctgaagccatggcccaggctgtaccttggctccttttagccatggctggagcagaaatgcagggcaccaagtccctaggctgcacagagcagggaggccctgggcccagctcatgaaatcattttttcctcctgtctctgggcctggatgaggggggctgccacagaggtctctgacatgccctggagacattttccccattgtcttgatgattaacatttgacttctcattatttacccaaatttctgcagctggcttcaatttctcctcagaaaatgaatttttcccttctattgcatcatcaggctgcaaattttctgaacttttatggtctgctccccttttaaactaagttgcaattccaaaccatgtctctgtgaatatataaaactgaatgcttttatcagcatccaagtcacctcttgaacagtttgctgcttagaaatttcttccaccagataccctaaatcatctctctcaagttccaagctccacagatctctagggcaggggcaaaatgccaccagtctccttgcatagcaagagtgacctttactccagttcccaacaagttcttcatctccatctgagaccacctcagcctggaccttattgtccatatcattatcagcattttggtcagagccattcaacaagtctctagaaagttccaagctttcccacatcttcctgtcctctgagccctcccagtctctaggaagttccaaactttcccacattttcctgtcttcttctgagccctccaaactgttccaacctctgcctgtaagttacttccacatttttgagtatctttacggcagcatctcactctactggtaccaatttactgtattagtctgttctcatgctgctaataaaggcatactcgaggctgggtaacttacaaaggaaagaggtttaactgactcacagttccacatggctggggaggcctcacaattatggcggaaggtgaatgaggggcaaagtcatgtcttacgtggttgcaggcaaagagtatgtgcgggggaactcccctttataaaaccatcagatctcctgagacttattaactatcatgagaactgctcaggaaaaacctgcccccatgattcaataacctcccattgggtaccttccacaacatgtaagaattataagagctacaattcaagatgagatttgggtggggacagaaccaaaccatacacaaaacatatatatatatatttgctactaagaggattttgattgattgtactctattattggtaataattagacaaagtgggagctaggaacaggaaaacaaaaagaagataaagcaaatggcagagcagggtaaagaagctttttcatcaatattagatcttactactttttgtctaataagaagaaaggttcctgccacatacatgaagtatgcttccaacatatcttaacatcatttcactaggattaccctgacactgaggtggtggaagagtggaagtcagtaatcacaggtcctaacattgaaatttgacacaggaccttatgaaaaagccctcttggtatgaatataagctgcaaaaaagtaaaatagatgtatagcaatgaaactgaggaaaatagaaagcctaagaagtttctaatgatcaagtgattgccaaggaatgattttacaatgctcattattgttcactaagatgtgtaatatgtcatctctaacctctgtatagaatgttcagttttaattgctctatcttagcgaatcaaacttctatatttgataaggtcttttctaaatttacttgtgacttcagtaaagagaaaatgggtcctaaattagggtagtagcaatgaaaatagcagatcacataaaatgctgtgttctcacttcataagggtagatggtactgcctcaatacaatttaggggcgaatataaaaagtttcacatttgtacatgttgccatatgacacactttcagtggattcagaccaagatttttataccataagtagttttacatgggatctttagcacaaaaaaaatgacctaggtaaaaaatagttaaatccatgagatagaattggggtgaatatcaacatggagggattgaaaggataaggaggagtatccaatagagcagttaagagaagaaacacaagaaaaaagtgttacagaagacaaaggagaaacaggggtggttagaattgttcttcagcctagatgtacgagttacattgagtcagatattatgacatattacatagcctttctatagtggagaaagtcttgtaatattaaagggaaatataatgaaacagtgcaaagttaatacagaagaacaaatatctgaaggttttagctctggaaacagaaaaaaaaaacagtaaaatgctacaccactggttcaagacaaattacagtgcacataaaaatgctttgagctaaacactcttagaattaataaactgtctggttattcaatataaattcacttgatttataccaaagattcatctgcattctacagagggaaaaaatccattttctcttctctttctaaaggatttctggactctgaaagaaagtctatgatgattaataaaagtctgttagaaatttgtgttcagagaaaaaatgtaatcttttttttttgtcttttttttgagacagagtctcgctctgtcacccaggctggagtgcagtggtgccatctcggctcactgcaacttccacctcccgggttcatgctattctcctgcctcagcctcctgagtatctgggactacaggcacccgccactacgcccggctaattgaaaaaatgtaatattttgtacataaagatgatattacttccaggccaactatcagccaaaatggttttgaatttttttttattctatggaaggtacaatttatactgaattttctagaactttcctatgtgaagcatatcatacactaattaaatggttagctggagatagggacatggtgtatggcctgctccaggctttctccactttcatcttatcttaagtttagtgccatgataactgccacatccaaaaataatttaacagagatcatattttagaaatattaaactgatatatttttccatttcccctaaattatagtgacttgcatttccctacctattttattaaataacctatcagataaaattaagacaatctctggacagtgaggcttgttactcattttccctggcacacactacaaacacttcaaactctcctcaaagtagtgctgtgtctaccactttatggtactgcccaggcagtgggatcgaaatggtttagagagtcatctgagtagagaagacctgaaatggtctctctcaaatctcccacagtcatagagatggggtgaagaaccagaaatgtatatggatttccaaggccttttcaaaggtgaatggaacatggttgaaaattaacagtgagctcaagtgcttaaggtcaccacgttactactttgagtcaagatatgtttgactgtagagacaggtttatctctcttttcctcagaagcctataataatttccaactacctatttttataaactaaaattatttcatctgaagttccccttccccaggattttcaatcccttgattccacaacatacacatgtacttctgatctccttaatcgtctctacttctcatttaggttcccttgctcctgccaggctcctttccattaggtcatctatattgccagtttcaaaacctggtaaaattacctaaattatgtcttaatgaagtataacttaactttctggaaaacaacttggcaatctatacaaaagccttaaaaaagatactaacctctgtccaatgattccatttttctgagcaaatataataaaagatacagagcttaatgcataaagatatccatcagaacataattcagaagaggaaactaatggaaaccacctaaatgaatgtatggtacaatagggcgactatagttaacaataatttatagcatatttcaagataataaaaagagtgaaattagaatgctcctaacacaaaaaaatgataaatgcttgaggtgatagacaccccaattaccctgatttgactatgacacactatatctttgtattaaaatatcacttgtaccccataaatatgtgcaactattatgtatccacataactaaaaataaaaacattttttaaaaaagaatctcagtagggtggttagtcaacatggtacatttctataatcaaatattatgtaatcattaaaacagttacataggaatatactaaaaatataatgctgaaaaaagtacagtatgtatttattttaaaaattccaattttgagcacatataaacatatatagatatgtgaattaatatgaaaaaattcacaaaaatgttaactcatgtgtttattttcagtgctcattcatttaaaacattcactcacacccacacccacccacacacacacacacacacacacacacacacacgcttatttaccatctaacttctctaaacaaaaaaggcatagtccttactctatggagttgccggtctaatggggaaggtacatttaacaagtaattacaacagattatagtaacacattccctttttcttaattatctgtctctattataactgccaactccatgatggtagagatcctatttctcatgtctgtcccttgcatccacagcatctaccacagcgtacaggatcataaatatttcatgaatgtagaggaggcccagagactaaatgggagcatattagcaggagggcctaaaataactcaggaggtttgaaaacttttttgagggcaagtgccatttaaaataaactctaaagaaagaggaagaactagccaggtgaaggaggttgaaaacactgctcaaggtagaaaatggctacaggtaaaagaagtggtgttcactgaattcatagactcaaacagtggttatttccgaataagggtttgtaggcaatttctttttcaaatttacttcagtgaaggcgtatttttgtgtccatcagagaaacaatagtctaaactaaacagattttaaaatctctgacttctcagagatcaccctgattttacatgtttattttcttactttgaactgtctctatacatacaatatggaacaaattattgcaaattcagtgtcctactttagaactatcttatacttcctcctatattttaagttctttcgggtaaagaatattttttttttcctttcctttatttggtatcttccatagcactggtattgtgctgtgtacccagtatgctgtattttaaagttaaataattatagtcgagaatactgatcttattatctggtggctagtttttgttccaatgactttacagagttagtcccagagaaaccaatgagaattatgaaattttcttttatataactttaaaaaatttatctcgttcgataaaaatacttcataccgaattagaataaaaattaatattatttattatcctaaaatctcagagacagatgtttttatttttttccaggataaagagcaaagaaaaatattctgatggtcaaagtaaccatgactacggttttcagacttataacaagtgttattttcatacactctatattggtaaaaataatatattcttataaaatatatttgtggtgaagcttacttttatactgcaacaaaattcttaaaattattcattaattctaccatcagtagcttctagggtaactatttttccagtaaataccatagtgtggactcttgagagaccagaagcggtccctgcccccgaaaatatgtaaaattgccactctggttactactaagaccataaatccattttaccattgttacctcgattctcaagggtaaggaataattctcagcttccccattccaggcccatatctaaagggtagcacaagtttgataggggctctcttcgagaaagaggaacagtgtggcattagctatgttactagaaagacccaatccctagtcaaagccattgagtcttgcccctctacataaatggatatagaccctcacatctagagctgcattctaggctattaaacaatctttttcaattgctgttgctggtatctaaaatttcaaattatctttagacaatgtttcagcttctatgataacatttcagaaacagagcaaataatgtgtatggtttatttaaactatactcaaatgtactgaaaattggttcacatttccaaagaaactctgtgaataagtacagcatgctattatactttaagactgtcattctgttcatactaatataatggtgactttattactagaaacaagattttctctatctgggtaattttagttctgttcattttagcaaaattgtaatgactagaaccatcttggtggttgatctaaagcacacgaaatgctctttattttgccagctacaaacatgttaatatgaaatgcattcacagaacggaaggacagttcctttctaaagtactacggtttgaagtgaatagtcctatcatggcaaagcacaagtggaaggaaactgaccattaggtcactattggatggtaagggtatttcattccactatccaccccacaactcaaaagaggaatctgacctagtggcttactagagattggaaatgaaaaaaaaaaaaggtgaaaagaatttatttttatttatatacttggccagaaattagagagaagcttttataatacagatatcaaagggttctgaagaaaaagacatggagaaggactgaagagaagagaaagaagatgaagacaataacgagaaaagaaaaagaatgttagactatgaaagttttttcaatgaaaagagtcaaactctgtcaaatatttgaagagatttattctgagccaaatacgagtgagcaatggcccatgacacagctctcaggagatcctgagaacatgtgcccaaggtgctcagggaacagcctagttttatacattttagggagacaaaaaacacatcagtcacatacctgaaagatatacattggttcagcccaaaaaggtgggacaactcaagggaaatggggggtgttccaagctataggttgattaagaaattttctgatcagtaattggttgaaacagttattatcaatagaaatgaatgtctaggttatgataagggtttatggagaccaaagttttattatgcagatgaagcctccaggtagcaggcttcagagagaacagattgtaagtgtttcttatcagatttaaagagtctgttctatcagtagttcaaaaatagaggagagtataatgaggcacgtccatccctcaacccccatcatggccagaaccagcttttcaggttaaatttggagtgccctggccaagaggagaggtccattcagatggttggggttgggggggtcttataattttatttttggtttacagtcctcatgaagtacagtgatataataatcaaagaaaacattaattttggtagtcagagaccaaatacagatgactgcagtcagaatcttgtgattctgaattttagtttcctattgaaaaaagtttgaaattcagaagcacaataatataatttataaagaatacctaaacttacttcattaaggaaatgggtaggcatcaaggaatgaacattctctgcaacaaataatacactatggcaaataatttaatgttaaggtacataagaattcttctcatccgaatactggatatcaataaaagaaaacattgattgatttcaacaaatgatccttaattaaaacaatcgaagcgataaagaaggaattatcaaacataaattgctaaactagtagcagacagcttttacatttagcttcatttgttaaatgaagtaaaatgcctatcttacttcaaagaatgttttaaaaattatatcagtaggattaggttgtgacaatagcatttaaattccatgagaacttattataaggaaactgcctaccctgacatttcctccatggtaaaagaaaagcattcttatttataataaataaattttctttagtctttttcagtttacaaagtgcctgtatacacattatcatttatgctgacaagcagctggtgcagtgggtgtttttttttaatctccgtcttgacagagagcagcaaagcacacagtcttagatgctagaatccatgatctatcactgaatagtttgtgacttcaggcaagttatttaaactctctaaatctcattctccccctatctaaaatgggggtatttatctgcctcatagggttgttataaagactaaattaaccaataactgtgaagtgcttaaactgtcaagtgctggagttagctgttattactacagataaaactgaagtggtcctgaggatgaggagaaattggaaacttcgtgtactgttgtaagaatgcaaatttatgcagtcattatgaaaaacagtatgaaatttcctcaaaaaactaaaaatagaaccaccatataatttagcaatcccacttttgagtatttatctaaaggaaataaaatcagggtcctggaggcacttgcacaatcatgttcatcgcaacattattcattaacagccaagatgtagaaacaacctaaatgtctatcaacagatgaatattttcatcagaaaaggtgatacacagacacacactcatacggtggaatattattcagcctttaaaaagaagtaaatcctgcaatatgtgacatggatgaatcttcaggacattatgcttagcaaaatacaccagtcacagaaggacaaatactacatcattccacttaaatgtgaaatctaaaatgatcaaactcacagaggcatagagtagaatcgtggttggtacgggctggggagaggaagaaatggggagttgctattcaatggatataaagtttcagttatgcaagatgaataagctctagaaatctgcagtacaaataccatgtttatagtcaacaacactgtactgtacacaaaatttgttaagaaggtaaatctgatgttaagtgttcttactataataaaaaaaaattatggttcatagaactggcctaaaactacagagtaaataatcagaagagtcaggattcaaattctaatcttttacataaggtcaagtgactttaagtaaaccttaaaatctaatccacattagttaaagcaatatgttattcctgaaagagcatagactttggtgcagacttaggcacaaataatagtttaactcatcagtgaaatagagacataaatacctaacttgtatagtcatataagaattaaatgagaacagaaactccatgagaccaaaatgtaagaactttataaatttaaaattgatgtcttgcaatatgtggcctcactgaaaatattttaagaggtccctaaacctataatgttatggttaccagccacaaaagacatatgagttagtaagatcttacaagattgtttccttaatgcaatagatgctaatatttggacaagcttcaatgagaatttactctcgtgttattagaaaattgtgtgaaaatagtatgaattgttccaattgcctgtatattttatatattctttttctagtaaaaaatgaaaagtaataagatgaatattttattttaaatgctgaaatgtacaaaacacatttttcagaaaagaggaaatcttattagtattagtatgtatcaactcattttagaaaatataaaactaattatgtccaactgaacaaattaacaccatcatagtctagctaagcattccaaggtcgttcctttaattttatgatctcgcacattaactcatattaaagaaaagaagattcaagtaaatctacttgggttaaaacatgcccctgtataatacctcttaacacctttaaataaatgattcaaaacaaaatacatatgctttgtgcatagtacatagcatacatcttttattgtactaaaatatgcaactaatccttcaattcaaccactacattattcctggggaattttctcaccaacttttgaaattacaacctaagtttttgtaagtatccaaaaatcaacacagtttggttcattggcaaatgtttgtgatatcaatttaaatagatgcatggcatctgtgaaatatgagatgctgggctccacagctagctatgaaataattttaaagccagaaactaccttgccaaaacaaattagttggtagactcttcgatctgaataacaatgtatatttttattttcaataaatagaaatatattaaatttctagcactgccacaacaaactaccataaattgagtggcttaaaaaaaacaaaaatttcctatctcagttttggaagctaaaagtataaatcaagatgtgagtagaaccatgttccctctaaaggctccagagaaggatctttccttgcttctttcaatcttctcatggtatcatcaatccttggtgttccttggcttgaaggtgcattaccccaatctctgcctatatactcatataaacctttttcctgtgtgtcctgtgtgtgcctctgtgtcctctcctcttgttataaggataaaaaatcatattggatttagaacccatcctactctagtatgtccgcatcttaactaattatacctgcaaagcccctacttgcaaatatggtcatattttgaggttatgatgaacatgaattttgacctagtatgggggtaggtttatgcttatttcatgcaattttaatctttaaagtatgtttaagctgtaaaattctgtgattccataattgtgagaccaaaaaataaactttgtctagcacaaaaatgcacaagttgttttctcaaaattagtgattttctcataattaaaatgtttattaccaaatcagttaatcctatatgtaaacattacagtacttcctcatgtttctggactttactcatgtaggtctttaatttcactacgctacttttacctcaggatagggcaaaaaagagaagtaaggaagcatctatattgttaggatcagagtgcaggaccgaggagaccaggagaggatactgatgagcaaaaaatgaattcattccttttgagtagattcctaggagtggaattgctgagtcatatggtaaatttatgttttactttttaagaaaacacaaactattttattgaaatgactatgcaattttatatttctaccaacaatgcataaaattctagtttctccacatcctaaccaacactaatattgtccatctttattattacagtcattaaaattacattataattgtaatctgtattgctctaatgactagtgatgtgccaggaagtcttcttagtggtcgttataaaaggtgaataatacataatacttgcctttacaacatttaatgtctgagggagagagagagagagagacagagagaagcaaaaattacaacacactacattaaatgtacacacactgttataccttttactaaatagttttgtgaaatttggacattttcccttatgaatgaagaattttgtggaaattcaactaagattaaacaaagcccaacattatatacaagccatcaacctgtgaagtatttcctccatgtacttctgatctttaaagcaatcatgtaagacgttctctcaactaagtacttcattttctttaaaggacatttgcaatagaataaagtacaaagtaatgctgcatttaagtgtcctcagggaaaagaaatgaacattattattttagcagaatgtccaaaaggtgattttaatgacaatagacttttctgatgatgatttttactgattttctcatagataaaatgtttattatcaaatcagttaatcctatatcaaatggtttctataataaaaataccaaaaatatcaaatggactttcaaaaacatcgaatggcgcctataaaatggagatcaaggcacatgaaaggatctctagcactcagcaatcctaacacttctattaaatatggaataattctatacctcttgacctctatgattgcaaagccatgtaaatgagctgtatacatagtcattttccttaaaccaagtgttaaattattttttaagtctctcagatggcctacctctgaacccagtaaaaactgaaataggggtgagaaaatgctgacctcttgaattatatacaaagttgaaaatattcttaaggccctaccaagaagtagagaattaccatctgagtcttgtatccatcagaactccagtctggagatgagagctaatacattgccacattagataaaacatatagataaaaatatgatgtaacatttttttgaaggatgaatgaacacaggaataggcattgtgggagctccaggtaagggaatagtgacttaatagtagccaggcactgggtattacaagaattcctccttccttcaaagagctcattgtccagtgaagagacagtcataaatacaatgaaaatacagtaccgtaaaagcagctaacatttattgaacacattctatttgcaagctatcatttttacttagattatctctttcaatcctcacaacaaaactacaagatagataccgttactatcctcattctacagatatggaaacaggcttagagacacaacttgcacaaggctacttgacccacctctaaccgattcaagtggcccatattcataaccactgaggcagctttactgccacttataccactactataaacatacagatgttaaaataaacatagcaggcacaatgggacagagggccgacttgccagagagagtcagaaaaagtttcacagagtgtgctctgaaaattaacaagaattttccagacagagaaacagaggagaagcattccagattgggggcaaaaatatatgtgataaaaagaagcatacacggaaataacagaaacaactgttgtattagtttcctatggctgctgtaacaaaataccataaacttgttacttaaaacaacagaagctattgcagttcatagtttgggatgccagagtctgaaatcaatatcgctgggccaaaatcaaggtgttgggtgggccacgctccctccagaggctctaggggaaatttcattccttgccttttttcagcttctggtgactgccagcatcccctggcttgtaatcatattgcacaatttttaagtctagcatcttgaaatttctccatgtctgtaaagatctccctctgtctccttcttataaggatacatgtgattgcacttagggcccacctagataatccaggacaatctcccatctcaagatccttaacttaatatctgcaaagaccctttttccaagtaaggtaacatttactggtaccaagaattacatctgatttctttgggggcatttttcagtctatcacaacagtgataggggagtccatgttggtagaattggaaaatacacaaaggagtaaaggtcatgagaaatgtggcaggtgggaggggtaaaatagaagaaactaaaagaggctagcaggtcagcagggaccagatgatgatgactagattggctacagacatgtttaaattgtattctgtaggtgacaggtaaaattgacatgttttgatttgcagcattatattgtgatatttgcctgttagaaaaaaatcactacagagttaatagtgaagagagatcagtagaaggcaagagattattgaaacccttaataattattcaggaataaaaagaagagatggataagatataaatttggccattatggatgaaatatagagaaaagaacaaggagaaatttaggataactcctaaatttacagttttgggcaactgggtggatagtggggataactgtgaataggaaataccataggaggtactaaaggcaaggatgaacctggctttggacatgcaaatctagaggtgtctgcatggcatccaaattgagattctggtagataaattgatatgaaagtctggagtacaaaaggatttagaacttaaatgtatacatctaaatttgaaaatttagagatctagatttaggaatcactggccatgagtatagttgaaagtatcaaataagtcagtgttagtagaaactgcttttattgctggtcccagtgagttccaaggcagtctcttcagaatttttatgctgccatgaatgtttcaatttgttcattggtgaattttagccacctagactgtatctaattatctcattttctttagacactgcctgtaccattttggaaaattatcttattaaagtcagctcagaaaaaaaaatagagcatttagtgttctatttacatgtgattatacatactcagggtcctggtgctagggacctcataaatgctgaaaagaactgttaatcttaaaaggctttgggaaaaaattattactaatattaaccctctagggaactaatgatgaaaaattaccctaccccagtggtccttaaaactttttcatcccgtgactactcaagctctacatcatttcttctacaataccacatcacataactgcaggacttttatgccgctgcgaagggaagaaagagattatcatcttcatgagaccacagggtacactaaataaatgttgaaaacagagcaccaggcagtgactgagaaaagctacaggaagactgcagagcctgaggctttgacaagcaggtgcttccgtggtcatcaaatcactattcatagacatgtcgttccaggccagagaatccagctctgagaaacaatgcctcagccattagctcccaaaagacatcaatcacgcctgccaagacacacagttagctcaggagggatttcaaaacttaactgggtcaaaaattgcttctaagcaggttttcttaatctaatctaaactgcaacttgagaaaatagaaggaattctacctccttctaaactgtggttcctacctacatctccaacactatttttatctcttttgttttccaagtacaaaatgttttgatccaatgtaaatgagctatgtattgctttctataagacctacaaattccttcctaccttctcacatcacttattctacccagaaagtcttccctttcctccttctactttcaaaatacaaatttcatagaaatttgctgggaccatgccagatagtagtcataatgcatcttcaatatttctgccataattgtaaaatttggaactcagtaaatgctgtcttgcatatatttgctttctgtatatgttatatgcctctaacaagattttaagttctgtggatggagtcagcatttaatatcttactgggataccggtgtccagtaggtctcaatagatgaggatgacaaagactccaaaatatacatctgccttttatttctgcctacgaagattttaacaaatttttaacctgtgtaaatttttctaactaaaattttcacctctttcttaccaatatagttttgttttcatatatgagatttccttactatctttgctttaataactattttatctcaaattttaacattgcctggaaaaaaacagatgacattgtagctttagattaattttcaaagtatctgattattttaatgtatcaagagaaagcaggaagagtaagagattgccttttgtgctattttgcatatataattggctttacacaaaaaataatgcatcctgtaaggacagaaaaggtgtaaaatctttcttcactcatcataaggatcacggtcaacactcttataataaaagacaagataacaagagaaaagcataacaggtttatttaatcaaagttttgcatgacacaatacccttcagaaatgaagattcagagacccaagggacaactgtcaatttttatacttagattcgatgaagaatggacagttgtgtagaaatgagattggacagaaagggtatgacctaatggtagactgagtgaggaaacctagtaagacctcctgttcttattcttcttgaactctctgtatagcagttcttggtcctaggtataggtccggaccccttctgaaatgagtcttgtgacctactataagacaaggtagaccagagtatttctttgtggccagctcttatacaaaaagctgggagaaagttagggtaatatttctaggttttatgtctggctttaggggagagggtttctagtttctatggcctgccttgggagagaaaggggagcaggcataaaaagggcaggagaaggtcagaaagatcttgcttctgtgacctttttctttagttcaacttattcagcatgctaaagtgccatactttgtggtaccattttctgagcccaacattcccccatctgaaacttccccagaaagtttaacagtaaaaaaattgggttgttggattgtctcataagccatcaaatcagtctttcagtcctgaaaatatgtctgtccaattagacaaataatggttgtgtctaatttgaggaggtggtattgcaggtaggcctccaccaaacttagtcctccatatggtgtgagtaatcagatatttaacaatagtcatttctataaaaacaaaagaaaacaaaaggtaatgtttgaagtaatccataaactcattcctgagtccagagggtatccaattgagacaatttctagatttggcctcaaagtatcttcaggtgaagacagtgcaggcagtggcaatctaacagctttttcttgcttttagttttcaagtgagctttctgagtaatctatacagcaacaggcatgaaggttgttcatacaaaagctgctgtggtgatttccctgaagtctacatcaagtcatcaagctttggctaattttagggcttcaggaaaagaacagttttaatttcaatgatatcaagccagaagggtgggagaaaaattaaaaatattattttggagagttgtggccagatattagaggaaactagaagaatttcagaatacagcccagatttcaggtagatatggaccctcaaaaacaattagttagaatctaataacaagtgcactatagttttcatctgacacataatttttctctctatacgcactttcatttctagtaaagatactcaaagtagactgatttgtttgcaaaataagtttagtctccttaaacttctcctgattatttacataaatccagcaaaaatatttattgaccattttctttgagatgagtcttgctctgtcgccaggctggagtgcagtggtgtgatctcagcttactgcaacctccacctcctgggttcaagcgattcccctgcctcagtctcctaagtagctgggattacaggcatgtgcatattggctctttttaagtttgttttgctgaaattttcaattaggaatctcagattagacttttaaaagcttcttgaggctaggaatccaagccaaggactcactgtcaaatttcccatagtatctatatagtttggtgaattcctctctgctcaaggggtccaaaatatcctgaggtttcagggctgtcagaaagtgacattctttagccatctataaggcaaccatgtgaactttgttcaagaaaccatgccagttattgcaaagcgggctttattggctccataatgtcaaccttagttcctcgatgttgtctgaaaatatgacattccagtcaaagccttgataacatagccagtgtttccaattgtgtcatgttacaaggagaacaaattcttactgaagttacacaaataataatattgccataaaataagaatccttacaaatagtttctgaattctggagggatacagtagaaaaaaaaagtaaatgttttaattctgtttacaaagttatactttaccaaattgttataagctatagatgccttcagagaaaaaaaatctttaaatatagaaaataaacatttaaaataagaaccagaaaactttcaaataaaaagtcatgaaaacatttcctcatcagttgattcagtcctgtgtaattaattcttattatgtttgatcttggttagcagtctcattaagtcatctgtttattcattagagttgtggaaattcttacctagtccaatgatatgatcccaaagttatcagaaacctgtacttgtcagagttatttccatcctttccctgaactttcttgaagacacaacactttacaattctagttgcttgcaaaaacttttcagaaagatcatcagaataaagcaattaactatagacaagacttaaaatgatcatggttagaaatctgttaagagttcattataaccagcaaatgacaaggaaatttggtgatttctgtggcatacaacattttaacataataaccaaaaattgtgaataatagcatatcagacttctaggaatctcataatttttaaacactcatatgaataacatccatagatataacttacaggtttagcatcccttattacttgacaatgcttcccatataatttagcatatcaaataagccaactggcttatttgaggccaactggaaaatctcaaagttaatttgggtcaaaaagacttaatttagaatttaattttgagaactttgtcaaaaatgtcaaaagctttaaaacacttggttaaatattatcttggatatttattaatcaaaatgacaataaaaaatgtttaagaggctgggtggagtgcctaacgcctgtaatgccagcactttgggaggccaaggcaggtagatcacctgaggtcaggggtttgaagccagcctgaccaacatggtgaaaccctgtctctactaaaaatacaaaaattagctgggcatggtggcaggcatctgtaatcccagctacttgggagactgaagcaggagaattgtttgaacccgggaggtggaggttgcagtgagctgagatcacaccattgcactccagcctgggcgacaagggcaaaactctatctcaaaaaaaaaaaaaaaaagaaaagaaaagaaaaaattgtttaagacaaatagagaaggttacatacttgtgaacaaaaactgagctcttttaatagaaaactcagttttcttaagtaatcaaagactaatatgtgaccacatgaaataaactacattaataaaacacaaaattgtttcctaggccaattacataaaaggaataaaaactgtcacattctcagaccaaaatactccaagaaacttttgtcattttaacagggaagaccaaattgtacttttgcttcagtgtactcttaacactaaaggtaattttaaataaattttaaataaatatatacaatctcagtcagctttgaccacacaacattttcataaacattttttaaacttttaaaaattgatacagaattatgcatacttatggagtgtacattgcatatatacaatgcaacataatcaaattaggataattagcatatacattatcctcagatacttatcatttgtttgcagtgaaaacattaaaaatcctctcttctagctattttcaaatatataatacattattgttaactacaatcattctactgtgcaatggaatactggaaattattcatcctatctagttgtaactttgaacccactgaccaacctctcctcattttcctctcccctctacccttcccaacctctggtaacaactattccactctctagttctatgagatcaacttttttagctcccacatatgagtgagaatatgtagcatttgtctttctgtgtctggcttatttcacataacataatgttttccagcctcatccatgttgctagaaatgacaggattgtattcttttttatagttgaacagaattaattgtgtaaatatgccaaatattttctaaatccattcatccattgattgacatttcagttgattcaatgtcttggcttttgtgaatactgctataataagcacaagtgtgcagttatttttttgacacactgacttcatttaatctgaatatataccctgtagtaagattcctgaataatatggtagctctatttttaattttttgatggaattccatgccaatttccctagtggttgtgctattttacattcccatcaacagtgtataagagttcccctttcttcatgtcctcaccagcatttgttatttttgtctttttgataataaccattctaattactgtgatgtgatatttcatcgtggtttctatttacatttctctggtaattagtgatgttgagcatttttccatatacttcttggccatttgtatgtcttcctttgagaaatgtctattcagatctttcacccattttttttagtgaaattatatgcttttttcctattgagttgtctggtttccttatatattctcattattaaccccttgtcagatgcatagtttacaaatgttttttggtataacataagcatttttcctattttttaacaaaaatgtgttctttattcattatgaaacattttacttcctcacaaagagttgtttcctttataatttctagtattttaattacatgtattaactataatttataacttttagtaacttaatttctagttaaaagtagcaaactttgtgaactgtctcatattagtacaaatgatttcattatttctagagacatgcatttcctcaattttttacatttattaatagatccaaatatatttagcttctctatatcttataaaaagaagacgccaaagtacataaacttatgaataatcatatatgttttcatattttaacttacttagaaataactcagacaattaatgagtatctctattacttaatttcactataaggtttcaagttaccaaaaagaatttttaaactatgacaagttcatttataaacatttatctcattcacatttacctaactgtattcattcttaacagttatgtttaaattgatcatgggaaacaggctattcatcatcttatctttttgttcttttaaaaaacaaaaccaaactaaccctacatttgccagccttgtcctaaccaaagcctctgaaacactggacacagataccctccccattgttcaccccagccatcctgggtcctaaacatccactcagcacccagaaggctacaaaaggcaaggtccatatggatggtacagagctcaggacagaggacaggaaacagacagctgtgaagacaatgcctggagtacttgactgctcccaggatggccaagaagcagagttaggccagggaggatggggccatactgggcttggccctcccctgtggttgactggcagcctaggcgctgcagaaacacacatgtcctagacttcaccatagcctccttcccagaccccagaatccagaggctcaaaactaaatacataggctcacaagatgtacacaaggctttatgggagcctagcagtcattccccctagctttgacctaccaataagtcaggcaagtatcaaaaatatcaaagaagctaaaagttaaaagttaaatgtagtttttcctttttttttttcccccatgactcatatacattttagcaatccatatttactgtgcattctactctgaggttggatttaaagtattatgaccttaaacacctagcagaggtaacatacctgtttgatcagcaaacacaggcaaaaatgtctatattatatttaatgacataatcatacagaaagaagcagatcctacagctttaactttaagccacatgccaggtccaataattcaagactcactagctggatttggcgggacacgttacctgctccagatggctagagctttttaccaatttgtatggagaaggcttctgagacttttcatgggaccagtttctaaacatttttttctttctgatgacagtcatctccctgaattttgtatttccagaagataaatatcaagttctagagaagtcaggataggaaatttacatctcaaaagcacagagaaagaatgcaagttttttcatgtagtttgaggaatgttcacctattaacagagatcagtcttataaaggatgtggactagattttaggctggtaactgaggatctagtgtatgaatgtcttcaaagccccctatgagtggtacaaaaagtacataaatgagcctaggcaaaaattcaggagtccattcaaaataaccagctgatcccattattacattgggttttgggtctcttagagctgaggtaaaagcctaagaggacaacatcccatagttgggtcatacaacattttcacaatgtaccttgttgcatgggcattttcttgaggctagtgtgtaacctaatgtcaattagcccattttgtgtcccgcttatcctaactcaggagtctctgtctttgtgtgcatgggtgtggtaagcactctagtagctttcaagtgcgcaaaccatgcacaccatcaaattgtggctttggctccgaaattcctttgaccaacttagccaatgattttcccattctgtctgacccagtcaaacacctgaggcttctcttatgtgagggcacaagaaacaaagaggatggaaacaagatataatacctgtgaatttggaaaactggagttcacatcccctatagcaaaaaccacttacaaaccacttacagcaaccgctgtctgttgtattgaaaactgcagctctacccagtaactggtcaaccaccatgaatccaaaagtcaaatgccttctcacagcacaaactaacccttggtaccccaaatgccaaagatatcagggagctcaatgccaaagagaacagaggtccagatgtgagaaggactaactcatgactcttagggaagacacaggaccaaatgaggaagacagaggaccacaaaaaggaggtcaggggcacctttcctgtgtttttcaaggggtctcagagtctttagaggtctccttccggtccctatgtatgattaccagaatgctgatgttttctcttagtaattttttatctgctgaccaacaaatggaggagggaaggagttgaaggcccactcaaggaaactgaatggaagatagacggtggcacaaggaggatacaggagcagaagaaatggaaagaagaggtttagaggagtcaatctggggagatcttaagttcaccaaaaaggccaataaagttccacattgtcctcaacaaaaatcacactaacaaggaaggaagtaaacagaaaaacagaatatgtagttagcaggagtttgagaaaaggagtttcagttgactgtgaagttcccatgggagaagcaggatccaacagagaaactcagacaccttagaaaaagcctgaatatcagcttccacttaaattgacttttcaccatacagccttttaaaaaaatcctttcaaatgtcttattatcagatttcagccaggacaaacaacaaataattctgatttttttccttttccttttaaaccaaaggaaggtatccatcaagtaactcagaaccaaaaccagtaagtcttttacgacttaaccagtgatgagagagacgtcctcaagagggtgcgaaaaggtacagtcctccaaagactcagaaccactcccaaaagaaaagtcaaaagaacgaaagacctttgctaccacaggaccaagcaatgatggtggagatgacaaaagcccctttgaattgggactttttataagaaaaaaaaaaaaatcccctgagagctggcacgataaaacagagagcattcagggacctcatccactggctgcctgacacaagccaacacttgtgctctctggctgacagagatcaggggggatattctcacaagtcttaaggccgaactctcaggatgtaaaaacgagacaaacaggaaagacaaagacaactgtccctgagagggaaaggatccataacaaatgggtaccccaaggctaaatttacacaacagtcacaatccaaacaaatgattttctcctgctaacctgaatttggaaaggaacaaatacagataaaattttaccatctattctcaaccaggcattatagacagagaccagggaagagctgatgttagtaaataattctccctttgccggcttttggtcagttgtcctaggatctcacctgcaggcactggagtgagtcagttgcctcagccgctccacattgaacaccagagttacaagcgcagaaaaggtatgacacctttcctacctatcaaaagggtcacaaccaacactcctacaagaaaaggttaacaagaaaagcataacagatttatttaatcaaagttttatgtgacacaatagccttcagaaatgaaggcccacagacccaagaggaaaactgtccatttttatgcttagatttgatgaagaatagacagttatacagaagtgtgattgggcaaaaaggatatgacctaatggtaatagactgagtagggaaatgcagtaaggcctgtcctcattcttcctgacctctctgtgtagcattctttcctcatgggtatagggcaagaccccttctgaaatgagggtcttgtgacctaccattagacaaagtaggtcacagaatttctttacagccagcctctacacagaaaggtggggaaaggtcagaataatatttccaggttttatatctggcttttggggatagaagttctaatttctatgaaccaccttggtgaagaggaattctagtttctatggcctgccttaggggaaaatgggaagcaggagaaagaagggtaggagaatgtcagaaagatcttgcatctgagttcaaagtattcgcttcagtccaaagtactgagaatgccaaagtaccatactttaagaaataattttctgagccccaacaatcctaatttgaaaagttaatttataggattcaaccttttttatatcagagatgctagctgggtagaggtgtacaacaatgaatgaaaacagaaatttttgttactgtagaactctttttgaggaagtcaagaatatttatgagtatgccttttcttcacagcttaactaaaggtctgttaacaaatgtaatagagttaggcagtatctttgagataaggtacctcaaaagtccccaaaggttcttccaaaaacactgtcactgccaaaaaaggttctataatcacataagtttaggaaattctccctgttctcttcccactttggagacacatatcatgacatctagtccacaaagtccagcaggagagacctcttcaatttcataaacatatttaactacaaacactttatatcaatagtgcctaataatagtctagaaatcagaactcgtaatcgtaatactatttaggcaatgttgatctggtataaaacccttattttacagatatttttaaaagtaagagtcacagaagttaaatagctatctagttcagatactctagacagagccaaatgaacccaatctcccaattccacgtttcttccatgactcattctttacatgccaggcatttaacctaatcatcactttgtaatttaaaatttccccatccagcctcaaatacatgtttgtttgtttgtttgtttaagcacacaataatatacattttgagcatatccaaagcttatctatcaccctggataactttctgtaagtgcctccctgtttataaaattaaaaacactgaatctgatagcaaataacctgaggcctctgtgataaatgagacagggcttcggggcgtttcagccagcctcccctgagactaggtttaagacatctccatcttatgtgaagacttaaattgtgttgtagcagcttcagtgaaattatttttaatgcccatttgagattttttagaaataatagagcttttatgcaggcattcgaggcagaatccttaatgaggtaaggcatgaggaatgaattcagaaggaagattttcatgattggaggagctatgcgtcatacctaatgtacattccaggaatattttatttaaagcaaaattagtgaaatatcaatctgtggaattctacaagaaattcattttataactcctccattattcctgtcatcagtaacttcatttttcacatatgagaagttctcacgtaaatgtcctgaatatctaaaccaatgtattcagtgcccagaatatattatacatccaggattcacaatattcacttaaatatgatgattagagcaaaattgtcagttaaaaaatagcagcagtatttagctgcatttgagggaatgtgatctgaagtaccacagcaacctttcttaagccccaagcaatgcaaagtcatgacatgtacgggttcagagacacagagctgattgagcaaaatacatatcccaaagattaatggtcatctgaaagaagataaaagatttattgtaagtttttatttgacatagtgtcacacaaaagtgatctatgatgtcttcaataacaaccaccaccacaaaataatggctaacacatctaatgctcactgtgtaccaggcacagttctaagcactttctatataatcactcatttcattatcataacatctccatgaaatagtactactattatctccacttaacatctattgaaactgagatgcagagagtttaagtaacttgccaaaggtcacacagctagtaagaaacaacacataggttggattcgaatcctcaaagtccagctccaaaatccgcaatgtctgagccttactaaatgccaagcaccatgagaggttctttcttgcattacctcatttcattatgcttatttaactttatttttaggataaaatcaactgtaaaatgtttttctctttcatttacaagtttgcatggcttgtggctacatccttgaatttatcagtaaatctccaatataataaaaaccagctgtgttccacctgaaacattaaaacattattctttgcattgcgtaagttaaaaaaactgtttagtttctacttctctagcctttcttgagtaagcagctatgggtagtaaagcatacaggacaaagagatatctcaggatccagctcacccaatgagggagctacaaaagacagcaaggaaggccttcaagtaatgagttagcaagctgtctagtgataaccctgagccaatgggaatgcccttgggatgtgtcctatgcttaattcaaatatctgtggcacagcatagcatccttgaactgggagaaacctctttgtagcattaccaccaatctttcctaagtaaagttagccatttccacctcagtgaggctaatcttcaagtaatttctattgttgagtaaagaaggcattttcgactattattcaaaagtcaaaaaaataacagacgctggcaaggttgtggagaaaaagaaatgcttataccaacgctgttagtagcagtgtaaattagttcagccattgtggaagacagtgtgatgatttctcaaagacctaaagtcagaaatatcattcaacccagcaatcccattgctgggtatatatccaaagaatataaattgttccattataaaatacatgcacacatatgttcactgcagcactattcataatagcaaaaacttggaatcaacccaaatgcccatcaatgatacaatggataaagaaaatgtggtacatatacaacacagaataccatgcagccataaaaaaagaatgagatcatgtccttttcagggacatggatggaggtggaggccattatccttagaaaatggatgcaggaacagaaaactaagtattgtctgttctcacttataagtggcagctaaatgatgagaatacatggacacatagaggagaacaacgcacactggggcttatcagggggtagagggtaggaggagggagaggatcagaaaataactaatggatactaggcttaatactttggtgatgaaataatctgtacaacaaactcccatgacacacgtttacttatgtaacaaacctgcacatcctgtacatgcacccctaaacttaaaaataaagtcaaaatatatgcatggaaaaaaaaaagtcctgccaatgcctgaaactcaacatactccaaattaaatttaccctatcctattccaaaaagtcaactttattttcaaagttttctaaatatcccagatttaaatgattctttgattcctaattttttttttcaccttgcatattaaccagtcactggaacccaacattcattcatttatttttcttcacaacgtctctcagattatctttcctttctgctttcgaggcaaaacagcatacttgaaaatccatagaggctgggcatggtggctcacaactgtaatcccagcactttgggagtccaaggtgggcagatcacctgaggctgagagttcgagaccagcctggccaatatggcaaaaccccgtctctaccaaaaatacaaaaattagcctggcgtggtggtgcatgcctgtagtcccagctacttaggagactgagacatgagaatcacttgaatgcaggaggcggaggttgcagtgagttgagatcacaccactgcaatccagcctgggtgacagagtgagactctgtgtcaaaaagaaaagaaaaggaagggaagaggaggggaggggagggaaggggaggggaggggagggaaaatcaagcccacacataggagttaatgtaggtcctggattttccatgtactaacagcaaagaaaaaaaaaaagaattctcagtagaggatttccacttcctttctactttcacatgactgttcctatacaaatgcaccaacaattttattgaaaatggttttttttacatgtagtatatttatgtgatctctactgttggatctctctattgtgtatgtttatactgaaccaaatctttcagtgactctgttcatgcttttcactcatttcatccatttctcattatttcattattcttcccatctcaaatcagtagtaatatttctaggattttcataattcaaagagagtgaaaatattcctttcggttctcttaattaattcttcctcaggaaaaaaaaaaagttgctttagtttaaggtttttccagtctagaatgaaatgaatctcaagaaatctcaaggatctccaatgaaaggggagaacttgcacccccaccttgaaaattacttcttacgcaatgattccatccattactgatatattgtatcatgaaaatagtgtttataaaaactatgggaaattttgaaaaatgcttgttaactgcaaaagcagaattccaaagtgtttacacagatgacattaggtaggtaggtaggtaggcagatagattacacagacagacagacagacagacagacagacagatacacacacataaactcatgcatagaaaaaaatcaagaaaaaatcatcaacataattttgttgggataatatgacttgttgtcctttcttatatttctcctcatttttcaacttctttgaataatcacatggcacattcaatagttaaaaaaaatgaacatttactttgcagaatacttacacatcaggcaacaaaatatcactttcttccaaagtactgaaatttctctgaatctagccctgtagctaaacaaacctccctgacaatgtaatgttctggtttgggagtctgtctttacaaatccatcacataaacagaaccaatgacaaaaaccacatgattatctcaatagatgcagaaaaggacttcaataaaattcaacaccccttcatgctaaaaactcccagtaaactaagtattgatgtaacatatctcaaaataataagagctatttatgacaaacccatagccaatatcatactgaataggcaaaagctggaagcattccctttgaaaaccagcataagataaggattccctttctcaccactcctatgcaacacagtattggaagttctggccagggcaatcaggcaagagaaagaaataaagggtattcaaataggaagacaggaagtcaaattgtctccgtttgcagatgacatgattctatatttagaaaaccctatcatctcagcccaaaaacttaagctgataagcaacttcagcaaagtctcagggtacaaaatcaatgtgcaaaaatcacaagcattcctatacaccaataatagacaagcagagagccaaatcatgagtgaactccgattcacaactgccacaaagagaataaaatgtctaggaatacaacttacaagggatgtgaaggaccttttcaaggagaactaaaaaccactgctaaaggaaatcagagaggacacaaacaaatggaaaaacgttccatgctcatggataggaagaatcaatatcgtgaaaatagccatactgcccaaagtaatttatagagtcaatgctattcccatcaagctaccattgaatttcttcacagaattagaaaaaactactttaaatttcatatggaaccacaaaagagcctgcgtagccaggacaatcctaagcaaaaagaacaaagctggaggcatcacgctacctgacttcaaactatactacaaggctacagtaaccaaaacagcagggtactcgtaccaaaccagatatacagaccaatggaacagaacagaggcctcagaaataacgccacacatctacaaccacctgatcttcaacaagcctgaaaaaaacaagcaatggggaaaggattttctattcaataaatggtgctgggaaaactggctagccataggcagaaaactgaaactgaacccctttcttacatcttatacaaaaattaactcaagatggattaaagacttaaatgtaaaacctaaaaccataaaaaccctagaagaaaacttagtcaataccattcaggacatagacatgggcaaagacttcatgactaaaacaccagaaccaatggcaacaaaagccaaaattgacaaataggatctaattaaactaaagagcttctgcacagcaaaagaagctatcatcggagtgaacaggcaacctacagaatgagagaaaatttttgcaatctatccatctgacaagggctaatatccagaatctacaagaacttaaacaaatttacaagaaaaaaaaacaaacaaccccatcaaaaagtgggtaaaggataggaaaagatacttctcaaaagaagacatttatgtggccaaaaaacacatgagagaaagctcatcatcactggtcattagagaaatgcaaatcaaaactacaatgagataccacctcatgacagttagaatggcaatcattaaaaagtcaggaaataacagatatgggtgaggatgtggagaaataggtacacttttacaccattggtgggagtgtaaattagttcaaccattgtggaagacagtgcagcaattcctcaatgatataaaaccagaaataccatttgagccagcaatcccattaccaggcatatacctaaagtattataaatcattccactatgacgacacacatggatgtttattgtagcactatttacaatagcaaagacttggaaccaacccaaatgcccatcaatgatagactggataaagaaaatgtggcacatatacaccatggaatactatgcagccataaaaaaatgagttcttgtcctttgcagggacatggatgaagctggaaaccatcattctcagcaaactaacacaggaacagaaaaccaaacaccacacatgttctcactcataaatgggagttgaacaatgagaacacatggacctggggaggggaacatcacacactggggcctttcaggggttgggggaaaaagggagggagagcatgaggacaaatacctaatgcatgcagggcttaaaacctagatgatgggttgataggtgcagcaaaccaccatggcacatgtctacctatgaaacaaacctgcactttctgcacatgtatcccagaacttaaagtaagatttaaaaaaaaaaacaaaacaaagcaaaacaaatatacataaacatagatacacacttaatacaatcaggtaggcatatactgagtgatttttaatgtaaattaaatcacatcaatatttgtttaaaatcctccaatagcctctcttttgaattgaaataagtcagaactctttacctagatgtacaaagtccaatacaatttagctcctaaccacctctttgacctcaatccctaatgctttccataactcactctagggcagctcctttggcttcatttgtgcttctttctgcctaatagagattttctgatggctgaccccttcctgtcattaggtatcaactcaaacatcaccttcccagggaggcctccatttactacacagtctagtctgtcatccatttcttttccccagcactgtttccatcacctttaaaagcttttgtatgtataaggacaaaacactgctgaaagaaattatagatgacataaccaaatggaaaaccattccatgttcatggattgaaagaatcaacatcttaaaatctctatactgcgttttttccccaacagggttgattagaggcttttagcacgcctcagtaacttggaagtagcataaaaatagtgcataaaaatcaactctggggactttaattcaagaaggaaaatgggaatcctcagcattcgtgaaggacacccaagatccctgggaggagaatgctggccaacagcttccatgacagcatctggctgacaaaaatgagtgaagccccagtatgtgagagaggcagagaacttcccactgtaactcatctttccactgaggattggagcaaccccaactgagaaagagcactttgtttctcccaagccttggaaataacttgggaaggggcttagagacattgtgagcgcaagacaccaggaaatactgcagacattttcccagacccaggactgagagcaggattctgtttttaattcgagtgcatactaagtcaagcttttctttgtgactcagcagcatagccatgcaggcattttagtctcaggccggagattggaatggctgctctggaacaggctaggaatctccataaccagagctgtgaaaagcacctcagtagtcggcactggaattgtactctaccctgtcacaaccctgtggtagaaggagagctgctacagctgcagtttctcctgggtgatgatacttgcagacagggctggcttggtgacctgctgtgtgtgtgccattgttgggtgctccagcctgctcccctgagttcatggtgcagcaggaccctctctgcctcatacccaggcagaaattcaggcattcagagcacaccctcacatggacccacagcctgagccaccccacccttcatgagtatagatcatgatgcatcaggaccctctccacaccatgcccaggcagatttccaggtattcagagcaccccctcactcacctgaatcagcagcctgagccaccctacccttcctgtgcatagacttagatacagtggggccctctctattcctaatgtggccagacctccaggcatttagagcaccgattcacatgaaacagcagcctgagacaccctagtcttcctgcgcatagatctgggtacaggaggctctctctgcttcacacccaggcagatctccaggcattcacctggttcagcagcctgaaccttcccacccttcctgggcatagattgtggtgcagcacggctctctctactcacgtccaggcaggtctccagacataaaggatacctgctcaccgagatcagcagactgacatgttctgtgcttcctgtgcacagatcctggtgcaggaggccctctgcttcatgcccaggcagatttctaggcattctgagaacctattctcctagattaggagtttaggctgccctcatccccctgcagagaacttggggctgaggaggtttcccaactccacacctaggcccatttctgggtgcttggaggccacccactggattcttgcttggcactggtacctgtgcctgccattggaggacctgttggcagacctgcctgttccagtaccatctatcttacccctctagagctgaggagggagctcagaccactgtgcactccacacattcacccattgcctaagacaaaagagagcttctcccagtaaacagggatcaagtatacacccagctacggtggcctcagctggctgttacctataagcgccatctactggcttgtaggttgaactgcacagcccaatataaaccctgccaacagaagagcacagggctgtagaagcaaagccaaaacaccctacccagtattctctacagtcacaccccttagggagatgggaaagggaaaaggacattttgaaaataatattacagagaaaaaaagaagagaaaatcctagatgcatgagaataattacaaaaatttgaagtgccagcatctccagatgagaaagattctggcaccatgaaaaatctgaatgtagtgacaccaccaaaggatcacactagctctccagcaatggtccctagccaaaatggaaactcaaaagtgacagataaagaatttaaagcattgattgcaaagaagctcaacaaaatccaaaacaaagttgaaaatcaacacaaataaacttctaaagcaatccaaaaaatggaggaatagataaacatctttaaaagaaatcaatcagagcatttggaattgagaaatttgaaattgaaaggaattgaaatactttcaagagaaaatttcaaaatacaattgaaagcttcaccaattgactcgaccaagctgaagaaagaatttcagagcctgaagactggtcttttgcactaacccagttagacaaaaacaaagaaaagagaattttaaaaaatgaacaaagtcttcaagaaagataagattatgtaaagtgaccaaacccatgaattattggcattgatgagagagaaagagaaaaagtaaacaatgtgaaaacatatttaagggaataactcaagaaaattaccctaatcttgctagagaggtagacatctggatagaagaaacccagagaacacctgcaagatactatacaaaatgaacatcatcaaggcatatagtcaccagcctgtccaaagtcaacactaaagaaaaaatcttaaaggcaaatagtcagatcacatacaaagggaaccccatcaagctaacatagacatttcagttgaaaccttacaagccagtagagatacaggcctattttcaacattcttaaagaaaagaaattccaaccaagaatttaatatcctgccatactaagcttcataagcaaaaaagaaataaaacctcttccagacaagcaagcactaatggaatttattaccactagaccaaccttacaagacatccttaaggaagttctaaacatggaaatgaaagaacaatacctgctaccacaaaagcacactaaggtacatagcctttagaccctaaaaagcaagcacacaatagaaactacaaagcaaccagctaattatttcacaataagatccaaacctcacataccaatattagtattgaatatatattgtctaaataccccccacttaaaatcacagagaggcaaattggaaaaaaaaaaaaaaaacaagacccatctgtctgctatcttcaagagagacatcttacacataacaccacccataagctcaaggtaaagggttagagaaagatctaccatgcaaacagaaaatgaaaaagagcaagggtcactgtctttatatcaaataaaaaagactttaaaccaacaacagtagaaaaggagaaagaagggcattacatagtgataaagggttcaattcatgagaagacttaactatcctagatatatacacacccaacattgaagcatctggattcataaaacaagtatttctagagctacaaaaagacttagacagccacacaatgaaaatagtggaggacttcaatatcccactgacagcattagacagatcattgaggcagaaaacaaagaaattctggacttcaatttgacacttgactaattggatctaatatgcttctaaagaatactccacccatgaaccacagaatatacattctacctgtctacacatggaacttactccaagatcaaccacatgcttgaccagaaggcaaatatcaataaaaacaaaaatttgaaatcataccaaccatacccatggaccagagtggaacaaaaataaaaattattataatgatctcttaaaaccacacaattacatgaaaattaaataactttctgctgaattacttttgggtaaataacaaaaagcagaaatcaaaaaattttcctgaaataaaaacagacacaacataccaaaatctctgggatgcagcaaaagcactgttagtaggaaagtttatagcactaattgcctacttcaaaaagttaaaaagatctcaaattaacaatgtaatatcacaccaagaggaactacaaaacaagaacaagctaacctcaaaggtagcagaaaacaagaaataactaaaatcagaacagaatgaaataaaagtgagaccccaaaagtcataaaaataatcaatgaaaccaaaaattgtttttgtaaaggataaaggataaaaaaatcaatatactgctaaacagattaacaaaaacaaagagaagaacacaatgagaaatgacaaaggtgacatacaactgatcccacagaaatacaaaagatcctcagagactgttatgaacagttatgtgcatacaggtgtatgcacataaactagaaaatctagaggaaactgacaaattcctagaaacacacaacctcccaaaattgaatcaggaagaaactgaaaccctaaacagaacaatatgaagttccaaaactgaatcagtaagaaaaaacttacccaccaaaaaagccctggaccaggtggattcacacctaaattctaccagacatgcaaggaagagccagtaccaattctactgaaactattccaaaaactcaaaaaggaacactgctgcctatctctttctatgaaaccagtatcaccatgataccaaaacctgtcaaagacacaacaataacataaaagtaaaaactacaggccaatatccttgccaaacatagatgtaaaaatgctcaacaaaatactagcaaactgaattcacctgcacatcaaaaagcattttaccatgatcacacagacttcattcctgggatgcaaagttggctcaatatatataaatcaataattgtaattcaccacacaaacagaattaaagacaaaaaccatatggtcatctcaatagatgcagaaaaagcattcaataaaatctaacatctcttcatgattaaaaaaaaatccatcaaaaaactaggcatcaaaggaagctaccttaaaataatgagtcatctataacaaacccacagctaacatcattctgaacagggaaaaaattgaagcattttccttgagaactggaatcatacaataatggtcactctcaccacccctattcaacatagtactggatgacctagccagagaaatcaggcaagagaaagatacaaagggcacccaaataggaaaagaagtcaaactctcttcttactgacgatatgatcctatacctagaataccctaaagactctgccaataggctcatggaactgataaacggctgacaaagtttcagaatatgaaattaacatataaaacttactagcatttctataaaccaataacatttggctcttatctgagagccatatcaagaatgaaaccccttttacaatggtcaccaaaaaataaaatacctaggaatacatctaaccaaggaggtgaaagatctctattaggaaaactataaaacactgcctaaagaaatcatagatgacacaaacaaatggaaaaacattccacgctcatggattggaagaatcaatatcattaaaatgtccatactgcccaaagcaatctacattttcaacgtgatttctaccaaactaccaacattatttttcacagaactagaaaaaaactactctaaaattcacatggaaccaaaaatgaggctgaatagccaaagcaatcctaagaaaaaagaacaaagttggatacatcttattacccaacgttgaactatgctataaggctatagtaaccaaaacagcatggtactcttacaaaaatagacatataaaccaagggaacagaatacagaaccctgaaataaagccacacatctacagtcatctgattcttgacaaatcaacaaaaataagcaagggtgaaagctcctcttattcaataaatggtgctggaaaaattggctagccatgtgcaaaagattaaaactggaaccctacttttcaccataaaacaaattaacccaaaatggattaaagacttaaacgtaagacctctaattgtcaaaatcctagaagaaaagctgggaaactactttttagacatcagccttgacaaagagtttatggcaatatcctcaaaagcaattgcaacaaaaacaaaagttgacaattgagacctaattaaagagcttctgcagggcaaaagaaaactatcaacagagcgaacagacaacctacaaaatgggagaaaatattcacaaactatgcctctgacaaaggactaatatctagaatctataaggaacttaaatcaacaagcaaaaagcaaataaccccattaaaaagtgggcaaaggagatgaaaagacacttctcaaaggaatgcatacaagtagccaacaaacatgaaaacaaaaatgctcaacatcactaatcatcagagaaatgcaaatcaaaaccacaataaaatactaactcataccagtcagaatggctattgttagaaagtcaaaaaatagcagaagttgatgaggctgaggaataaagggaatgcttatacactgtatgaatgtaaactacttctgccactgtgggaaacagttgggagagttctcaaagaactaaaaatagagctaccattcaacccagcaatcccattattgggtatataccaaaaggaaaataaattgctcgaccaaaaagaaacctgcgctcatatgtttatcacagcactattcacaacactgaaaacatggaatcaacccaggtgcctatcaatggtaaatttgataaataaaatgtgatacatatataccatgggatactatgcagccataaaaaaaagaataaaatcatgtcctttgcagaaacatggatgcagctggaagtcattattctaagcaaattaatgcagaaacagaaaaccaaatgtcacctcttctcataaagcgggagttaaatcttgggtacacatgaacaaaaacatgggaacagcagacactggggagggaaggagagaggtgggtaaaggctgaaaaacttcctactggttgctatgtttactatatgggtgataggatcaatcatatcccaaacctcaatttcacacaatatattcttgtagcaaatctgcacatgtaccccgactctaaaataaaaatagaaattttaaaaaaactgtacatagcacctatcattatcaagtctccttgcttatttctttacttgccattgtttgtctccactcctagaatgcaaaatttatatcactgcatccttcttacttaaaacagtgtctgatacatagcaagagaacaataaataaacattaaaggaatagcaactgaagaaagacagtgataagaatagtagttgtccatgatacaaatgttggttttaggattctctttaaaaacatacatagctgatttccagtcttaccaacttcatgataacaatgcagctggtgtaacttaatatatgcaaataaatataaatacttctggaaaaagtcaagaagtaaagaaaacgttcacaggagaggatgagaatatagaggttttgcttatcacagagagtagtaagaaaagaaatggaaattgagtccaatgagagtaataaaagggtaatgatagtagagaattggtttctagtggtggctgaggtataataggattagtccagaaagtctccttgtggaacatgggcacttggttctatgctttggtctgccacacatcaggcatcttcttagatagccccccaaggaatggctgaaactagggcatctgtgatcatcaactaaaagatacctaaatctttctatgaggtgtatgagactgctatattgactatatggtgatctgttttcttctatatcaaaatgaaatgctctaacctgagaaaaacaggttacatgaagaactaaaacatatagtttttagttttctgggctaaatatatgttgcaaaaatacaaaaccatttaagagcaaattacaaatttaattatcacaaaacaaccagcccctaaaatatcaccttttcaatatattttaagtagccagcggtccaccattgccatgaaaaatggtacatcaaaggtatttaacatgctgtaatttattctccacttccaggtgacaatgacaaattgctcaagttccctccttgttctttgcatcatcactacatgtttgaaaaatcgatatatcacttgcaaccaaggattacaaatgcagcccacatcctttcactttcttttttctttccccatctatcagagcatttccctctaatcattgcttacctgttctttcctctccatctttacttgttctctccctgagaccatattccatcttcttcatgaccaccccaatcttttacctcacactcaacaaagcaattctttacccacctttataataggtcaagctgctagccatgaggaggccacagggcctgactggcatacattggggcgaatggaaaaccatcctgggaatctagggtttggtaaggagcaagatatcaggaaagaggcatatgagaaagaagaccatggacagggcctgagcagcactagaccgcagggtcaatcagagaggtcaggtgtattatgatccgaaggcacataaacacaccagaaataaagaacaaggttggtgatgtctttcatctttctatgattgtttctcccttctattataaaatatgcactggccattcaaaggatataataaaataatagacaccactttcccttttctctcacaaattcccttataatccctgataattttacatgctttcagaatgttagcgcctgataagtaaaacaaaatttcagtttggccacagactcaaagcaagaaataggactccttgaagttgatttgaaataaatatagctatatttttgctgctatagcaactataaaatagaactatttattgacatatgcagaaaacaacataacattttattaatacacaattgagatgttctttacctttttatgtttacttattaatgggttattagtcattattagaacatttacatgatagagtagtaattaaaacaaaaagagaaattgaatgcatcctttagctataataaaggctaatgtttattatgtgccaggttttctgttaggcacttgacaattatcagttcatttaatcctcacaaagcaatgtagtattggaattatcctcattttacagatggggaaatggagggcgattcagagaaattgagcatattgttaataagtgatacagtcagaattagtacccagactgccaaacaactcacatttgccaaaaagcaaagatgctttttacactattccagcatatctccctacaatgacaccaaaggaaacttcagaattcaacaaacatagcctgagggcctgcggcatgcaatgcacacagcagagtgtgctggagatcataaacatttgtcagaaacaaatgttatcatctaaaagaagagataaaacatgtatataaacagctataataaaaggcagaaagccacagttatcaaaaagaaattctttgcatgttaagagaaagggggttatttctggtggagaggattaaataagactttaggaaggaaatggaccttaaagtttataaaattaatagttttgcaccaactacttgctcactgacattaggaagaagtacccatctcgcattccacaaagaacgtacagtcatgtatcatttaaggatgaggatacattttgagaaatgtggcattaggtgatttcatcgttgtatcagcatcactgagtacacttacacaaacctaaatggtacagcctactacacacctaggttatggtatggcctattgctcctaggctacaaacctgcacagaatgttactacactgaatactgtagacgattgtctacagtattaaccatttgcatgtctaaacaggggaaaggtgcagtaaaaatacatcattataatcttatgagcccaccatcatatacacagcacttcattgactgaaaggtaattaggcagttcctgaccacgtctcatttagaaattagtttctaaaaatccagagtggttctacaccaatcctaatctggtttctgtttctaagaaatgtgtttaagttaaacatctaaaaaaaatttctgtgaaattttgagctttgagcttaaaagtctgaaaacttacactctggattctggttacatgtgaaaaatactttttaaattattgtccacagcattgttgccttttttctaagctttcgtttttctgtacaggataaaacattttctcatctgaaaatatttccaaatagacccttattgccttaatctgttttgtgttgctattagtataacagaatacttcagactgggtaatttattcaaaaattagagatttatttggctcacagttctggaggatgggacatccaaagtcaaggggtcccaatcttgtgagggccttcttgctgtgttatcccatggtggaaagcatcacaatggtgagagagcaagagcagagggagccaaacttactttgtatcaggaatccattcctgcaataatagcattaatccattcatgagggcagagcccttgtaacctaatcacctcttaatggtcccacctcttaatacttaatgggtaggacattcaaatattagtacatattaatgtggatcttattatcagtattaggattctaatttatttattttgtagacctgaggtcagccaacttcaacaaaaatccatcctaccacttgcttttatgagatcttattgaaacacagctatgtccgttcattttcatattatctatggctcatgatacaatagcagaactaagcaatgtgacagaggccatatagcactcaaaacccaaaatagttaccatctaaccttttacagagttgcagacctttgccatagaccatccattcactcagcaagtatttattaagagcttataagggcaggtggctggtaggtagctagcataggttgttggctgaaaaactgtagcctcattaaactaagttaaaagttaattcatactgaattgtattcttcaatataattatcttcacatacgagaaaaaaacttgaacaacttttcctgtggaaaaaaatgtactaagtgacttggaatgtaatattactaggaggtactctactattactacttacactattgagtaacacttattgagcatttactgtgtgctcaacactattataaacacttaatataaatagtatatgtcattattcctcactacacctctaggatgtaagtgctgttactatcctcactttacaaatggtgaaattaagactcaaaccaattaatttctgaggtcacacagcttatatttgttaaagctgggactttatagaagatgctttcattcttggagatattaaaataagagagtggataacttattaaaaaggtaaaatggtgtacctttttaaggggagcaaaatataaataactaccatttactgagagcctactatagttctgtcattatgctatgtgctttaaaaacattctctaatttttatatcaacccttcaaggtaggtataagttccctcttttacaagcaatgaaaaaataataggttatatgactgacaaaaggtacataccttgtaagttgcaaaactaaggttaaaatttagatctacctgtcttgttctagaatacatgctaaattctattttttaaaaaatcctaggtgtatttttctaattcttgaaactgaactgcacttacaaatgaaagcaacagatgttcagcagctgaacaatgaaatatcagataggacaaataatgaaaatataacctacacaactaaaatagcagagaaaaatatagaaatatgaagcatatttctatatgtaaatacagaatttgttcctaatggtagccaggattcaaatcagaataagctacaatagaaatttctgaaggcactaaaataatctgaaatctcattaattcattctctaataaagcactgatgcattgacacttagcagatatctctgttgtaatcagttatccccgtttccatgggagaaggggactggtcaacccatttccatatttttgctgaagaaacatctaaagatgtgaacaatacccttctcttagatatgattgaataataaagaaaaaaaaagaggggactctgggctttaggaccaaagagaaataagttggtatattcacctctgctgcttcataactgtgtcaccacaacaagctaattgacttctctgtaactgagttttctcatttaaaaggatgtttatgagagatgctgtagaaaagcatcaggcatgccctcttaaaacacatctaagggaattattattctttcagttgtaatcacttttctcaaggaagatctttaagagaaaatattttctcacttattccctttcctagtggggagtaacaggagcaagactcactgtgtgatgccccgcgttgccttgggactctacagcacgtccttaccagcaagaaggctctcaccagctctggccccttgacctttgatatgtttggctgtctctccacccaaatctcatcttgaattgtagttcctacaattcccatgtgtcatgggagggacccagtgggaggtaattgaatcatgggagcgggtctttcccatgcttttctcatgatagtgaataagtctcaagagagctgatggctttataaaggggagttctcctgtacatgctctcttgcctcatgtctcatgtaagacatgactttgctcctcattcgccctccaccttgattgtgaggcctccccagccatgtggaactatgagtcaattaaacctctctcctttataaattacccagtctcgggtatgtctttattagcagtgagggaacaaacttatccaatcttggacttctcagcctccagaaccataaaatacaaatttattttctttataaattccccagtttcaggtattctgttataagtaacagaaaatgaattaatacagaaaattgttaccgagaagtggagtgttgctgataatgaataactaaaattgtggaagcagctttggaactagataatgggcagaagctggaagaatttggaggagcaggctagaaaaagcctagattctggtgagggtttagaagacaagacaactagggaaagtttggaagtccttagagattggttaagtagtcatgaccagagtgctgatagaaatatgcacagtaaaggccatttcgatgaggtttcaaatgtaactgaggaacaagggagtggaaaccagagcaaaggtcattcttgtcataaatgggcaaagaacttggctgaactatgttaatgctgagggctttggggaaggcaaaaatcaacagtgatgaactagagtatgtggcagaagaaatttctaagtaaaacataaaagttgctgcatggttacttttggctgcttacactgagaattgaaagcaaataataacttaaagaaagaatttataatcaagagagaaggagaattgaaagatttggaaaatgctcagcctaaccacataaagaatgaaaaaatgtgttcaggagaggaaaccaagggtgtagcccagtgaccacttgcaaaagagattactacacacaaaagggagccaggtgctattcctcaagaaaatggaagaaagacccagaaagcatttcagaaatcttcaaggctctcccatcacaggctcaaaggctgaggagagtagagtggtttcacgggacaggcctggggtgctcattgcccaggtccaacttgtgactttgctccccacacccttgcatggtgctccatggttgccccagccatggcttaagtggtcccaggtgcagatcatgccacagttcctgatggtacaagtcataaactatagcaacatccatataatgttaattctgtaggcttgcagaaaacaagagctgtggaggcttggcagcctccacccagatttcaaagaatgtcatcaaaagcctggggtctcaggcacagacttgttacaggaaaggagtgaccacagacagcccctgctagagcaagaaaaagtggaaatgtggggttggagctgctgcagagaatcctcactgcatagggcagtacctagtggagccataggagcaaaaccaccaccaaaatgccagaactatacagctgccagcatgcaatcctagtcgaggagagctgaagcatgagctaagcccaggaaagccacaaaggcagggtttttcaaggccttggggacttaacccccacatcagtttgtgcagaatgctagtcatggagtcaaaggagattattcctcacccttagatttaatgtctgccctcttgggtttcagacttgtttggggcctgttactcctttcttttggcctgtgtcttccttttctttctatatatatatatatatatatatatatatatatatatatattttaattatactttaagttctagggtacatgtgcacaatgtgcaggtttgttacatatgtatacatgtgccatgttggtgtcctgcacccagtaactcgtcatttacatcaggtatatctcctaatgctatccctcccccctccccccaccccaccacaggccccagtgtgtgatgttccccttcctgtgtccaagtgttctcattgttcaacttccacctatgagtgagaacatgccatgtttggtttttgtccttgcaatagtttgctgagaatgatggtttccagcttcatccatgtccctacaaaggacatgaactcatcattttttatgtctgcatagtattccatggtgtatatgtgccacattttcttaatccagtctatcattgttggacatttgggttggttccaagtctttgctattgtgaatagtgccgcaataaacatacgtgtgcatgtgtctgtactacaaggctacagtaactaaaacagcatggtactggtaccaaaacagagatacagaccaacggaacagaacagagccctcagaaataataccacacatctacaactatctgatctttgacaagcctgacaaaaacaagaaatggggaaaggattccctatttaataaatggtgctgggaaaactggctagccatatatagaaagctgaaactggatcccttccttacaccttatacaaaaattaattcgagatggattaaagacttaaatgttagacctaaaaccataaaaatcctagaagaaaacctaggcaataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctaaagaatgggagaaaaattttgcaatctactcatctgacaaagggctaatatctagaatctacaaagaactcaaacaaatttacaagaaaaaaacaaccccatcaacaagtgggcgaaggatatgaacagacacttctcaaaagaagacatttatgaagccaacagacactgtgtcttccttttctaatggaaatgtctaccatatgcctgtataacaccactgtatcttgaatgtaggtagcttgttttgatatcatgagactatgaattttggacatttgggttggtgctggaacaagttaagaatttggggctatgatgtggaagaaatggatttttatgtgagaaggacatcagttttggagggccagaagcaatatactatggtttgaatattttcccatttcaaaactcatgttgaaatttaatctccaatgtggcagtattgagagaagaggcatttaagaggtgttgggtcatgagaacagagccctcatgaatggattaatacattcatcaattaatagatgaatgagttaatggattaatgggctatcatgggagtgggactggtggctttataagaagaggaagagagacctgagagagcacattcagccccctcaccatgtgaggccctgcaccaccttgggtctctacagagttctcagaaggctctcaccagatgtagccccttgaccttggacttctcaacctcagaactataaaaaatatattacttttctttataaattacccagtttcaagtgttctgatataaacaacagaaaataggctaatatatctatttaatgcataaaaagagacttgaaaacagaaatttataccatgtccctgagtaaaatattaaatgttgtaaaatgctaattttatcctaaataatctctaaatttgctattcttccaatcaaaatctcaacaggtaaaatctaaaactgtaaaactcttagaagaaagcagaaaagctttatgacattggatttggcaatgattgctgggttataataacactaaaagcacaagcaacaaaagtaaaaattagataaattggactacatcaacctttaaaactgtgcgtcaaggggacacaatcaacagagtaaaaaggcaatctatgaaatgggagaaaatactcttaaatcacgtatataaagtgattaatatccagaatatataagaaactcctacaactcaacaaaataacccagttaaaaaatagaaaaaagacttgaatagacacttttccagagaagatatacaaatggtcaacaagcacatgaaaagatgcccaacatcactaatcattagggaaatgcaaatcaaaaccacaaagagatgttacttcacaaccatcaggatggctactatcaaaaaagctaagtaagtgttggctaggatgtgaagaaattggaatccttgtgtatcattggtggaaatttaaaatgatgcagccactatggaaaacagcactgcagttcctcttaaaattagaaatagaattaccataagatccagcaactttactgcttggtatgcatccaaaagaattaaaaacagaatcaaagagatatttccaaacccatattatagaagcatttttcacaacagccaaaaggtggaggcaacctaagtgttcactgacaaatgaatggatcaacaaaatatggtatatacacacaatggaatattattcagccttaaaaagaaaaatcgtgtcatatgccacaacatagatgaatcttgagaacattatgctaagtgaaataagccagtcacaaaaagataaatattgtatgattccacttagttgaggtatctagagtagtcaaattcctagaaataaaaagtagaatggtggttgccattgacagatagggggaggaataaatagaaagttttgtttaatgggtacagagtttcagatttccataataaaaaaactttggagactgattagacaataacatgaatacaattaccactattgaactgtacactttaaaaatagttaatatggaaaattctatgttacgtgtatcttcacaattttttttaaagttcagtagggtaattatgcaaatgtaacatttaaaatcaatagaggaagctggattattcgataaatgatgctaggacaactgatcattaatttgggggtaggaaggaaccatagataaattataaatctgaaaataaataaaactatacgaagaaaataaggtaaaatattttataattgtggggctggtcaaggtcagcctaagcaagatacaaaatccagaagctttaagtaaatacacagatagaacacttcataaaaattaaaacttttacaccacaaaaaaaagataaataccaagaaacaggctggaaaaatacttttaaaatatttttaacagacaaagtctgttaaatatatttgatctagaatatacagtctagaatatagaattctgtttggtctagaatatacagtcaattcttgctttcacagtaattttattcaataaagccaccatgaacaccaagttagtaaatactaaatcattgctcctaagagaatgcaggtttagattcctggagcctctggtcacaatatttttatcaactgatcaatacaaaatcttgttttgtatatgcttctgtttaaagacaacttatttaacatatattgttgatttattaacattgaactcacagccatgagttccacaatataactcatacctcagtgaagcttatctgacacatagattttctccataagctacatcactagtgtttcttatgcctctagaaacactagaaagtacttcagcactacactggaggccattttaaacagtgaaatgcccaaggaaaaccagaaaattttttttaaaaaactggcactaaatagaatatgaaaaggacacttgtttcttgtttacagtatgagaactgaaacaagaaggcagagtgttgtcttgttcaacctcaactgggactcaactgggaacatgtgcaattttccactgctctgtgcacgtccatgaatgagaagaaccatgaaaacaaagaaccatttatgattacaaattttagcaaataagtgaatttccaaatatggcatccactagtaataagaatttaatgttttaaaatacacttcaaaatcaattctttgaaaaatataagaagtaaaaataatttgattcacatgagaaaaaatacaattgcctcaaaaatctaaagggaaacaaaagttccttctcactaataatcaggaaaatgtgacttcagtcaacagtgatgatgatggccgggtgtggtggctcacacctgtaatccttgcactttgggaggccaaggtgggtggatcatttgaggtcaggagttcaagatcagcctgaccaacatagtgaaaccctgtctctactaaaaatacaaaaaagaaaattagctgggcatgttggcacatgcctgtagtcccagctactcaggaggctgaggcaggagaatcactttaacctgggaggcggagtttgccaagatcgtgccactgcactccagcttgggcagcaaagtgagactccatctcagaaaatagtaataataataattgatacctctgatatggtttggctgtgtccccacccaaatctcatattggattatagttcccataatccccatgtgtgatggttaatactgaatgtcaactcgattggattgaaggatgcaaagtattgatcctgggtgtgtctgtgagggtgttgccaaaggagattaacatttgagtcagtgagctgggaaaggcagacccacccttaatctgggcaggcgcaatctaatcagctgccagtgcagctaggataaaagcaggcagaagaacgtgaaaagaatatgctggcttagcctcccagcctacatttttctttcatgctggatgcttcctgccctcaaacatcagacttcaagttcttcagctttgggattcagactggattccttgctcctcagcttgcagcctattgtggggccttgtgatcatgtgagtttaacactccttaataaactcccctttctatatatatataatatatatataatatatatatacacacacatacacatacacggagagagagagagagacataaagagagaaaaaaagagagagagatcctgttagttctgtccctctagacaaccctaatacaccatgtgtcatgggagggacctggtgggaggtaattaaatcacggggatggttacccccatcctgcttttctctgacagtgagtgagttctcatgagatctgatggtttataagggtatttttccccctttgcttggcacttctttctcctgctgccatgtgaagaagaacatatttgtttccctttctgccacgaactaatatagtaaattggtaacacagagagtgggggactgctataaagacacacgaaaatgtgaaagcgactttggaactgggtaaccggcagaggttggaacagtttcgagggcccagaagacaggaaaatgtgggaaagtctgcaacttcctagagacttgagggctcagaagacaggaagatatggggaagtttggagcttcctagagacttgctgaatggctttggtcaaaatgttgatagtgatggacaatgaagtccaggctgaggtgtctcagatggagatgaggaacttgttgggaactgcaataaaggtgattcttgctatgctttagcaaagagactggtagcattttgctcctgtcctagagatttgtagaactttgaatgtgagagagatgatttagggtatctggtggaagaaatttctaagcagcaaagcattcaagaggaaagagagcataaaagtttagaatatttgcagcctgacaatgtggtagaagagaaaaacccattttctggggagaaatcaagtgactgcagaaattcacataagtcacaaggaaccaaatgttaatcaccaagacaatggggaaaatgtcttcagggcatgtcagagacattcacagcagcccctccaatcacaggtcctgagacctaggagggaaaatacggtttcctgagctgggtccagggtcccccgtgctgcctcacaacttggcgccctgcatcccagccactccagccctggtctaaaaggtgccaaggtacagctcgggccatatcttcagagggtgcaagccccaagccttggtggcttccatgtggtgttggtcctgcaggtccaacagaagacaagaattgaggtttgggaacctttgcctagatttcagaggatgcatggaaatgcctggatgtccaggcagaagtttgctctaggggcagagtcctcatggagaacctctgatagggcagtgtgaaagggaaatgtggggttggagcccccaaacagagtccccactgggggactacctagtagagattgttttagaacttaaaggtttaatgactaccctattggatttcagacttgcacggggcctgtagcccctttgttttggccaatttctcccttttgaaacaggtgtatttacccagtatctgtatccccattgtatacaggaagtaactaacttgcttttgattttacaggctcataagcagaagaaacttgccttgtctcaggtaagactttggactgtggacttttgagtaaatgctgaaatgagttaagactttgggggactgctggaaaggcataattgatttgaaatgtgagaacatgatatttgggaggtaccaggggtggaatgatatggtttgcttgtgtccccaccaaaatctcatcgtggattttagttcccacaacccccacgtcatgggagggacccagttggaggcaattggatcagggacagttacccccatcctgctgttctcataatagtgaatgagttctcacgagatctgatggttttaaaaggggcatttccccctttgctcggcacttctttctcctgccgccatatgaaggatgtgtttgcttcccttcaatcttgattgtaagtttcctgaggcatccccagcccagcagagctgtgagtcaattgaacctctttcctttataaattacccagtcttgggcagttcttcatagcagagtgataacttactagaacaacctcttaacaaaaatggtcagataggctgggcatggtggctcacatctgtaatcccagcactttggtaggccaaggtgggcggactacctgaggtcagcagttcaagaccagcctggccaacacagtgaaaccccatctctactgaaaatacaaaaattagccaggagtggtggtgagcacctatcatcccagctacttgggaggccgaggcaggcgaattacttgaacccgggaggcagaggttgcagtgagccaagattgtgccactgcactccagcctgggtgagagagcaaaactccatctcaaaataaataaataacttaattaattaaaataaaataaaattagacaaaaacgatcatacaaacaattcatcccacactgtcttcagctgtccgtacttcatcctccttgtagagcaattttgatgattcaagacaagtgaatcaaaaatacctaaaatgatgttgctatggtttgagtgtccccccacaaaactcattttgaaatttaactgctattttaataatattaaaaggtgagactattaaaagataattagaccatgaggactttgccctcatgaatggataaatgtcattattcttggagtgtgtttgctatgaaaggatgagttcaaccgtctctcattctcttgacctctcttaccctctcaccttctgccttgggatgatgtaggaagaaagcccttgacagatgccagcaccctgatattagacttcccagccttcgaaactgtgagaagtaaatttcttttctttataaattatccagtcggtggtattctgttacagcagcacaaaatggactaagacaggtatggattgaaatgaaaaatgaacggatgagtgggtaggtagatggatggatgaatggatcaatggataaattggttgaatgagtaatgaatggacagatgcaagcaataacttgcaaactattctacaggaactcatggtgccataaggagtcattacgactttttacaacttatggcatttattttttcagaaaatataaaatctttattagaaaaattagatctgcttgtcataaataattcaaacaatgtttaagtatataaagcaggaagttaaagtctcccttgaatcttaagccttagaaataaccactatagctgtatactatacatacttccagattttctgagcacatacaaattaacattgcacatattagaatgcacttattatatgaagttgttttatactatacatactgccaatcctaccaaaactgacagagtgatgtctctgaaggccacaaacaaaacaatttttaaaaatgtgcgtttgtattgtaaataatttatagagaatcttgcatttatattgaaagagcttcataacaatcctacaaacaaacaggaactagcgtcctcattttaaagaagcagcagcagagggtgagttacttgcccaagattttatggccaacaaataatagtcaggccaattactttaactaaattataaagtttctcagagcagaaaccacacataattccagttttgtatcatttacagtacctggcacaaaattataaacaggtatgaggagggtatgatgtttatattgcttactgctctatgccacacatataacaaatggtcaataaacatctgtgaaacaaatggatggaaagatgtataaaagaagaggaaatgggaagagattctaaatgaactaagatacttatcaaaccatcattttttcaatttggacaataataaatacgtttagcagctcatccactccgtaagcataatacaacatgataaccaatatcattgatatcaatatcaaaatgatatcaattgaatatactctagataagagtgacatcaacaattactgatttcctctttaacagtgaaatgccatagtaaaaaatattgaacagtagacactatacacccttattgttgctaaaagaagctattccgtctatttttttaattttatatcaaatattcacatggaatttggctcaaacacaatagatatgcaaactataaaagtataaatagtccatagggactatgggaaagtataaatagtccatagaattactgtgaaatataagtgagacaaggaacgttaagtgcttatcactgcacttggaatgtggtaggtactcaataagtgttagatatcattattaacatcactattaacatcatcatcataaggctttcctaaaatgattaaaaaattgaggctttccaaaggcaaaattatagttcatttattttaaaagttataaaaataactgcacaaaacaataaaaatctagatcacacaaatgcttgacaggaaagctgaaatgcatttttctgtaaaataaatatatgtcccatcttctgcctagatgcagactacaggcatattctccttgagtgcatctatgagagatgaaatgtctactgacctaatttctgtagctattgtatctgtttcttacagccactgtaacaaaccgccacaaacttagtattatagcttaaaataacaaaatatgttttctgacagttattgggatcaaaagtttaaaagacatttcacagggctaaaattaaggtgttagcagggctggttacttctggaggctctaaaagagaatctagggggcatggtggcttatgtctgtaattccagcactttgggaggccgaggcaggtgaatcacctgaggtcaggagttcaagacaagacaggccaacatggtgaaaccccatctctactaaaaatacaaaaaattagctgggcgtggtgatgcatgcctgtaatcccagctactcaggaggctgaggcaggagaactgcttgaacccaggaggcagaggttgcagtgagccaggatggcaacagagcaagacaacatctcaaataagtaaatttataaataaataaaaataaaagagaatctgttccctgcctttttcaacttcaaggggccacctgtattccttggctcatagcctcttcctccatcttcaaagctagcaatgtaacatcttcaaatctctgctttcctcatcatatcacactataagtaccttcataattacattgggcacacattgataatccaggataatccccccccatcataagatcctttagttaacaatatatgtcccttttgtcatatacagtaacatattcataggctctacatactagaatttagacatttggggaggagcattatgctgtctttatcacagtacatcctctggacaccaaataatcacattcttccacatataaaatccattcatgccatctcaacgtcccataaatcttaacccattacacaacatcaacttaaactcaaaatctcaaaaactcaaaagtcccaaatttcctcatataaatcaagcatgagtcagacgcatctgtgaatctgtgaaactggaataaaaagttattcgctcctaaaattcaatgatatgacaagtgtagcgaaacaattatagatatccccaaccaaagagagagaaatgaaaaataaaaagtgagtcaacagtccgaagcaattcagaactgcaactgggcaaactccattaggtttcaagccctgggaataatcctttggagttctcagctctaccctctcgggcctcagtcccatcctctgagtcctcctttctattccataaaggttaacttatgtttgcaaactcagtagtttcataagcctatttcctgcctgcagaatttcaggaatccaacagccttctttcattttatcctctgtccctttaagtccaagctaccaaagtctccgctaataaaccattcatgaaaacactgtgggtctcccaggtatgtcacaagaatttcctggataatcccaactctgaatcccatctcagcgtaattcatctcatcataattcagatctgctcaatctcttcaaagagccctctgtgtggttgaataatctcagtttttgatcctcctgaggcactagaaacaagttatctagccatgctttcagctttctctctaagtacacttcttgacagtgaatctaaaaatttcagtgttttttgcaatctggatagattgagaatgttccaaccatcaagtcctggtttctttgagtttaaatgttcttctcacaatttatctctttcctcctcccacatttcagtataggcaacaagaggaaaccaggccatacctccaacactttatctagaaatctactcagcaaaatatccaagttcatcacctactagatctgctttgcacataaccatagaatataattcctctagactatctgctattatatagcaagtatctcctttcctccagttttcaataacatgtttcctatttatttctgagtccttatcagaagcacctttaacattcatatgtttattaacattctctctacaatgatttaggtattctctaagatcatacaagttctctctaccatttcccccgctttcttctgaaccctcacagtagtgactttaacatcctcgtttgtataaacattatgtttatgacaattaggtaatctctaagaaaatacaggttttctctaccatatcacttctttctgagcccttattagcggcatctttaatgtccatatttctgttcaaggcaatctaagctctttacatcatgctcctcaaaattcttctagcttctacccagtgcccaattccaaagccatttctatatttttatgcacctgttacagcagcactccacttccaggtaccaaaatgtggaatagtttcctagggctaccattacaaattaccacaaacttagttgcttataacaacacaaatttattctctcatagttctcaaggtcaaagtctaaaatgattctctctgggctaaagttaaggtattggcagggctatctccttctggaggctcacagggagaatccacttcctgttttttcagcttccagaggcctcttgcattcctttggtccatggctgcaccactctgacctctacttccatcatcacatatcttctgactctgaccctgctgcctttctcttacaaagaccactgtgattacaccggacccccaacgtaatccagataacacccccaattcagatcctaaactgaatcacatctgcaaagttcctctgccacataaggtaatatattcacaggttgtgaagattataatgtaaatatcttttgggggaattattctgtaaaccacagccatgttcattattaactgatttctgtttaaaatacttaacccatattttcaattacatagttttaagcactaacaccgctgattgcctatcttactgaactaatatcttgccatttcctcatttcaaacgttggttcttttaaaagttttgggaagacgaaatttagcaagagaataaaatcatatattgaattaaacaattcccagagcagttatacgaataatatctcgattcattgttatggttcagagtatctccaaagtatgtagtagttttgttgttgggagagagggggaaagctaaagccctatcacaaaaccgtaactattctggagttgaaagatagctcaggggtcatctccatttcaaggctgagaaaaataaggcccagagaggttaaattattaacccaatgacataaactccaacagagaggagagagtatataaatttattttaatatatctagtgactaactatatagaaatctgatttaacagcaaccacacagaaagctgctgcattttcataaaaggaatttcttaatctcaagttcaggtagttttttatttagctatctgagcttctcaagtcttgaggcaaatgctaaaaaggtagttttctaaacagctagaggaatttcagacaaaccccatcaaattcataaaaataggtatttgccagaatgctacataggatggttatcaagccaaatgaaagaggttccaccgttgtcagtctactgactggtgtggaaaatccaaacatctataggctctataagtaatgtagtttctggcttccttggagaccagcgctctaatggaactctaagacaaatatcttgtcatatatgtgtatagcaaaaaagtacttttaagaaaatcagtaaaaaaaaaaaaaaaaggcacttaaattaaattttgctgtgtccaatactaccaatcctgttatcccttatgaaaaacatcagaaccacttggacacttttaaaacgttattttactaaatgtgtatttggtttcttggttttgccaattacaagataagtaacatagacttgaagtggaagttaagatataaagactttaggaagggcagtaaaaagtgctattgatatgtgaataggcatctcaataaataaaataaaaatactccaagtatccaaaataatcaaacatttcaatatgaaaggaagaaattatgtttgcattgacttatgcaactaaagactcaagtgggctgggcacggtggctcacacctgtaatcccagcacttggggggccaaggcgggcgaatcacgaggtcaggagttcgagaccagcctgagcaatatggtgaaaccccatctctactaaaaatacaaattagccgggcgtggtggcacacgcctgtagtcccagctactaggaaagctgatgcaggagaatcacttgaacccaggaggcggaggttgcagtgagccaagatcacgccactgattccagcccgggtgacagagtgagactccatctcaaaaaaaaaaaaaaaaaaaaaaaaaaagactcaactatggctatggctctgtgtgtgtgtgtgtgtttgtgttcacatgggttatcatgtgtactgtcatttcaataaagatattataatcttattgaattgaaaatatttgcaatacctagcaaaattctttacagcttttttttttctcaatacaatctgatggtaaagaatagagcataaatgtgatgtttaaggctcttttcattccatagccagggtatgaatgtctaggtaaaactcaaaaattgcatcaacagtttgagggtgagtcaaaacataaaatttatcatggctatagaaacagaaaaaaaaaaatacattgccaataaaatagttatttcccctggtaacagaaataaatttcctaataaaaatagaagttaaaaagaaaatgaaaattatacctaagcactttaaacatttcactgaacataattccatatccacaaacacatacacgtggtcttacataaattgaatctcacctatactatgagtttgaaatcagtttttctcttattctttaagaaaaaaaaaggtcagggatatcttttcatgtcaataaataggaaaactacgtaatcatttttagggctgcagactgtcccgtcacagaagctccataatttatttaagcaatcccctattgtaagacactaatgctgtttataattttttactctacaacaaacattgataaacatcctgtaccaatctgtttaccaatttatccaattctctctttaaaataaatgtctacaactagaggagctggataaatgagtatacagagaatgtatattaaactcttgccttgcacagaaaatttacctctaacccttttgaaagcaatttgccagaatgcattaaggtccctagatggtaggttggtggcggggtagtggtctgctgagctgtggagggcggtggggctgagggtggggtggagagggcggtgcccctgctctgaggcagggactactgggtgacagagacaaaggggtgtgtgatggggcaggtcacaatgggtaggggaggataaaagtggtcctgcggggtggtttagcagcagtggatggttcaggttgggaagaagagcagtgggattgccagttaaggttgtggaatcaaagagcaaaggctgttgtgaagtggaatatcaggctcaaatggaggtccctcccgaatgagcactgacacctgtgtgcccggacatccacgagggccccaacacctgtgctcctgacagctccatgcactaagcagggcacagtctggatccaggggactgactgtctctggcattgagcggttggtaatcaataccccaccctccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtggtgagtctatgcagagactagatggggcctggatgctttgggggagagcaggtacaggtcctgtaaagcctttggtgctgcagctcacctgggaaatgcattgcatttggaaggtctgaaggccaaatgagcttccatttggaggccatggtacattgaggaggttcctagtgcttctccagggttctccaagcctgaatttcagagatttcttagctgtcagcaactcttcattttatatccacagctgttcattttatatcaatgttgtaatgctgtccaaagcatcctgaccagtctattctgaaacacatactatgacctaggcaggctgatatgttgtaggacgtgtctccctgcaattgccacttatatacattggtggcaacacaacatgtttgtgtacttgtgcaataatttctttttgttgtttacctataggaagagaaaggagatcttgctggtctcactgtctttgcttatttgttctctccctagggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtaagcaccaccacaggtaccatggatgtggctgcaaccaagtctgcagactcaggagagaaacacagcactggcaaaagcagccttcagaggtccaggaggaagtatagccagcatggctattagtgggtgcttccatgtcttaatcttgttatagcaagggctgcatgcacattcttgtcctaaaagggtacttcaagcatatcagtaagtgctactggcctctccctagagagcagtatgaatgtggtggctacaggagcagagagatactgagaaggctgttgcattgacagtatctctctgctactcaaaggctgactctctgctactcagcattgggagtcagttatctcaactctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactcaaattatctgctctaataacatatgctctattgacaggaagggtagcaataaaactaatggcaatttatgatcaggctctgaaaactatctttaactttcccttaactttatattttttaaataaattaatagatgacagaataaaatgttgaagattactctcagatatgatcctacattaggagaattattctaaaactgttttccaaaatataaaatgagaacccaggaatacacacacacagactctctctctctctcctctctctctccaggtttgaatcacagcattgccacacattaactgtgagtttcagtagattgtttctttaaatggtcaccttgagaccatacatgtataatatctggaacatagtaggcactgtgtaaatggtagtgttgagaaacaaattctgagtttaatcatactttccagaaagggcttaattttcccagtctcttcattcttgatttcctttcttaaatcttaattaactgctttgcaattgtcccataaaagctctatttacagtaaatcttctcagtatcttccaagaattttaatcccctgacgctatttagaattctaaattttcatgaatttgtagaaatttcaatctagttacaatggaaagataattgcaaagcactcatcttttacctggttctctccaattttagtattcttggagatagaaaaataaaatgtaatataggatcaattcataatctggacaaaaactggaaattagatcattttagaattgtaagatccacatccatgggattagccaatattctaattttgcaagtaaaaagtctgctcgagtctaaagtaatacatcacatggtttgagaaccagaatgtataggtaacctggcccccaattatgtctgtattgtttccataacactcatgattctgacaagcactgtgctttgaatataaaagatatttgatacatgtttgctggatccaattaagggctataaatgtgaaatataatttattccaatcaaacaaatctggggatataaaattttacatagtactgtactaattgtacagatcccaaaggcccctgtatatattgtaaggaagcagtttaccagtagaccctcacagcgcttacgacttaatgatttttaatggcctccaaaagtgcttcagacctgaaaaaaatggtttcaaaatatgaaaaacatttcacaggttagatgttctagctttgcgaatttcaaggttacattactgagaaatcacatctaaccataaatcacttttcagcaaataatttcaaatgaaaaaatttaaaaataaaacaatttttgtttttcatgtggtacgtagcccagtatcatatgatactggagaccccctaagaagctttaaaatgaccatattgcaaactcttaacagagaccaactttatctttatattcaaggactgtcagcatgcttaccacattgtagtcccttgataatcatagaagggatcattgttaaaagcactgcacattttgtattttttctctaaatcttaatctgactcaatctctttttaaattgtatattcctttggtaaatatttcaatctgcttctgattacaaatcctgatgcttattactatcagatcctgttcctaggtcacagttttcttaaaattctaaaacaatacatatcctgttacctcatctcttgtaatcaaagtttaagagataatttagataatagatactgataataacagaaaaagatttaaaaattaccatttgtgaatggttgagaatggttgaatcctaggtaataaactaaaaaaccagatgaattaaaaaatgttgcaaattgtgtatgtgtgtatgtgtatatactatatatatgtacaaatatactatatatacacaaaaatatgctatacatattatatttttaattgcaaaacttcaaaaattctttaatatattttgcaatgaaaatgtatatatataaacatgttatatatacataaaacatgtttacatgtgtatatatatatatacacacacatatacacacacaaatataaatgctaaaggatagcccttaaacaataatattcacagacacacacacacacacattcttaagaatttatagtgagaggctgggtgcagtggctcacgcctgtaataccagcactttgggaagccgaggcgggcagatcacttgaggccaggagtttgagatgagattggccaatattgtgaaatgccgtctctactaaaaacacaaaaattagccaagcatagtggcgcacccctgtaatcccagctactcaggaagctgaggcaggagaatcgcttgaaccagggaggcagaggttgcagtgatccaagatcgtaccactgcactccagcctgggaaacagagcgagactccatctgaaaaaaaaagaaaaatttatagtgagagaaacattagtaaaatagtcttattgctggtttgttagattaaattcagttaaaaaaaaacacccaaaacctgtatctcaagtacatttatagatttaatgcagtaaaaattaaaatcccaatagagatactttttaaactcaacatagtacttacaaaatacagattttataaagcaagcaatcaagtcagctgctagttttaatttaataatggataataccaacactgagtcatgtggtttaaaaaataggaaggcagaaataaacaagccttcagaagtaaaaccaaaacaaaaggataaaaacgagaggaatatgagttattgttcaatggaaagtcataggaaaactagatatcaacaagcaaaaaataatatagagccataattgaaatttatgttaaaaggagttctaaataagatgaattaaatgaaaaataggattgagaagcttaatcaactggatagtttttttaaattacatgatgcacttgtacacatacaaattaagacaaaaagaaaagctgcagactgggaaagattttgtggtaaatgtaactagaacatctgaggaattaataaacttattgaacaataccagtcttcaccaaggaaatggccaaaggtaaagcaaacctaatattaaaaattgtagaccaaaagcaaggtactaccaagcctaaaaaataataaaatcaaatttagaaaaaagcaaatgttagtaaggtggtagaaaatcagatacaatcatattactgacagctttttgatttgcagtcatctggctaatatagtaaataccctgattattttatttcagtaattatttttaagatataaggcaaagtaatgattaggaaatgtatttttacaaatgcagttttatgaggggaaaataggttaaaacatttaattattgataaactgctaagcagttaagggtaagctaataaaatacaacttatgcttgttaattttctttccctttacccatgtagatatgaggtaaaaaactatatgtaaaaactttaagtgaagacatgacaccctagaatatacacatttgttcactgagattcattcaactattacttcattccaattatttttttttgttttacatccatcagattttgcttgataaagaagacatttttttctcttcctttctttctttctttttttttttttttttttgagacagagtctcactctatcataacccaggctggaatgcagtggtatgatcacagctcaatgcagcctcaacctcccatctcagcctcctgagtagctagggctatgggtgtgtactaccacacctggcttatttttgtattttttgtagagacaaggtctcactatgttgcccaggctggtcttgaacttctgggctcaagcaatccaccctcctcggcctcccacagtgctgagattacaggtgtgagataccacatcgaacccattcttctgatttgccaggaactacgcgttagactgcagatgctgagcatcaaaaggttgaatctctacctttatggagctcacagtttagtatgtatttacaacaattctgtaaaggttacagtaaactgtcttaaagtcctatgaagagattttttaagtactatatactgatttgaatatcctacttagctttctacaacaaattaatattgaaatttgaggggctatgatcaaattatgatacagacatgtggaagacgtgatggtttcttagacataattgtttcgtatttgtcgtgacagaagggaaaatatctttgagatgtaacacttttctggataagtactgtgatttatcttctgtcctggactgctttttccacccacgttctatgtaattaacctcttaacattataccctttcatattaagttctttgcttattgtgcagagatattttcaccatggcttcaaatttcctatctctggaatattttagtcatttctgaaactcctctaagagtgtatggttcacaacccacaacaggaacctgaaggtgatactacagatttaaagtagtcttaatgatagtgaaatgacttgaaactaatagtcaatattttagtgttctggtttcatttttggattttattccaaaacctccagaagtacacattcccattattctacaatgctccattgtgatgtgaaaaatataatcactggctatgcttttaaacagccataatatgtttccttatatctgtagacaacttttactttttaaaaatagcattctttaaactgatatatttctggattcaaaatattaaaacctcataaacaagataacttttctgcattataaccaaactaaataatactaattttttacataaattatgtcttcgcatatgtacacatatgcacaccaagttatatgcacattttacttgacactttgagaaaaaccacaagatccaaaatcacaaagtgaacaagatcctaatttgattttcgaaggggagggagattttatcttaaaaacataggcaaccatttttgttttattgtaccttaataaaagcaaacttttacctgggcaagcatggggaagccaaggttcctacatccattacacggagttaatgcttcccaaagtcctgatggcccacacgtattttcatcatcatcctcttcttccacttctcctggtgacaaattgattgtagatgaggttctctgaaattaaatttatatcataccaatatattatatcaatgatatttagatatcttaacatcaattaaattctataaatgacagtggtatatctcggcaaacaagtcagctcacttttagccacagttacatggctgtgccctgtgcctgagataaaaatatgtatagtccaacttaagttaaaagtgaaaaaaactaggtgtgaaagacttataaaataatatatgaagttcataatgaagaatagaacatgataatggcctaataaaatatttgaatagcaacaaatgagaaaaatcttatggtttatcaagaatttaggtttaggcataaaattaaggaaaaatgcagttagggcactaacaggaaaatattttattgaaatgggaactcctgataaaccagtttgttcagaatgccactgaaataaaactttataaactttcatatcatacatataacaggagtaacagttttaaaattcataatgagacttccatatttagcacatatattttccttcgttatctcccaaatctcactaaaatgatggtagaacatttataaaaatgtttacaccataaaaataaggatgacaggagagatgaacagacaatattaagaaaacttctggataatgttgagtaacttttggataacagatgggtattacctgacttagcaaacatgagaacactgaaagcaaagaaccttcatgtggaaagaattggagggactggctacctgtgaaggtgtaagtgtaggtggggcagaaacagactgaaactcagtatcagaaagaattatacccctagacccatctccttttcacccagccaggaaactaaatctttaccactggcaagaaattagaggtttaatttttgaagaagttgaagcaaaaggattatgaattctaagactacagatatactgagtctccaaaaacaagagaattaatatctatatagtaatgaagattcataacctaccccgtgccttaccatatttgcattagacaacatggcagcacggtttatattcccagataaacaactagaatactcctccctgtagaaacagacctcctaagaaaaaaggtctataaataagcaggaaaatggtgggatctatgtatcaatctctactgtgaagccaacctctcaacaagttccactcacaagaatcatatatttgagaaaaacctcttaacagacaccaaaataaatatagagaaaaaagttataaatagtatcctcagagagaagatatttatagccatgaaacaagaacagaaagttacaaaatacataaaatccaatacaagagtaagaaaaatctgagaaaatttcccaaaagatgaacagaatttaaaagtggagaaaactaggggtcaaaccaagacctctaacatctgaacaaaaggagctccaaaaattaagagtagagatgggagggtcaaagaaataaagcatgaaaatttgcagaaactgaggaaaaacttcactctaagagcctgctgaatacttagcagactcaatttaaaaaaaaagatgtatatgcataaataaaaagaaatacactaaattgtctaaaggtcctctgaatgtagcgttcagcacaacattgatagatcatgattactaaagcaagtaaatatattctacatattggattgtaaatagcatcctccccccaaaattgttccttttaaaaatagaatataagattttatttttcctcctatttaaaagaatttgttttctgcattcacattttaacttccccttgatcacttgtcagtaactaagaagcaatgaaattaagttgtcccccaatcagttgctgtctataaaatacaataataataacaactgttagactgagaacttactatgtgacttggagtatcactggcctattgtctgttaactattttaattcacacaacagccatttgaggcaaatatttttcctctcactttataaatgaggaaactaagggacagagaggccaagtaaaacccaaggtcacgaagctggcaagtggcagaaaaaggattctaacccagactagggggctgcaaaacctactctcccctcaccactacattctgtgaccactcctttggtacaataacctgtggaagacaatatactgaaaaaccacactgatgtaaataattgcagtttaaataaaagaggtatatttggtgaatacgtttctgttacacgagtaaagtcctgagagcattttgccttctgtgacagggagtgaaaatttctgcaatttgatacatagcagcccatgctttcataaatacacacttctcaaatcaataatagaaggtgattatcacagggatttttgaccctacagatcctttgagtaaaataaaaaatcttgggaaatttaaaatcttaatctgaaagagtatatatatatatatgataaagttgttcacaggaataaataaaatgatcaaaaaggtatctcctttaccagctcatgatcagctaacagtttgaccatcaacattgatgcggcacatactataaaccacctcatagttggccaagaattatcaacattttagattaatccattcttttctattttgttaatggtgctacaatgatttaatccaatcacacagggaacttcctctatctctttctcctccctcaaaaaaaaaaaaaaaaaaaaaaaaagcttatctctcttccctgctcataaagctccaattacttcccatttcacagcaaatgatatccaaattccttaatctggcttcagagttctatagtcaaatgattttttagcccttttactttttcactatactcacctcagattataaccaggtggaattgtttacccttgcctaatcatgctctatgcttttattctttctttcaccttacttgtctgcacagcgtattgtagtggttaagggcttgggctctaaaattagacagtcctgaattcaagttccaaatacccgcctcactagccgtatgattttcagcagataagaccattgtcagcctctcttgccttatctatgcaatggaaaacaatacagtggaacctctctcagggctttttcctgatgactaaatgaggtaataaatataaagtgcctgacacatacagcttcaataagtattaactatcatgtttattattttcttataatcccactgattcaaaatagagttcagatttcatcccttacctaaaattttccagatttcccacaagcatgcatgatatcatgttcttctgcttgtctctctttgtgcaaatgtttgcatttggtatttcacattcaccttgagttgatagatgctatagtggcaaagagcattggcttttaactcaaacagatatatgtttaaatcctagctctaccacttccaagctttgtgattttgagcaaatcacataatcttattaatccttagtttccctatctgaaaaaatagtgtaatcatttccacttgcagggctgtatgaagatcaaattaattgcttgacagagactggcacataaaaaatcaataagtactgctattttattttttaccataaaagagttgtgtacacacacacagtgtgcttgtgcaaatatactacacagacacaagtgtggcttatttacccttgtgaagtaagttatttgaaagaaaacattgccttattcacattgtatctcctacaatgtgttgtgcataatgaaacaataaatatttattgaatgaatcactgaataaatgagcttcaaattattattttcatttgactacctagaaaattttactaatattaaggggtgtgtataattgtatcacaaatatcaagattgccattttagctttattttatattaactattacaagtagctttgcagaaatgaagaaacttatcagtggtttagcactgccccctaaagacagcatataaattggctgtgtaaaaccataatttttaacttcatttctttacagttaaagatttgaaggaaaatattttatcaagctacatataatcttcaattatatatgggaagaagccagcggaacacacttaacctcagatggtttcatttattccaaatgctgttcaaactttttactggagaacaaactctgttcctgaagttccagaaagatgtgaaaattctactataaaaaaaaatagacctaaatctatacagtttgaacccattagctttcttggttattacacggtaataaagaaagactggaccaattctatgttgttgcaaattgaaaaacagtcacaataatatactgtagggagacaaacttgagctcaatcaaagaaaaacacttttgagaataattatattagtctaacattgaagaaatgggatttccctgtgaggcagtgtgtgttcgtgtgtgtttgtgtgtctgtgtgtgtgcatgtgtgtatgtgtaaattatatgacaactatatataacggtgcttcataatttataaaatgctttcagatagagaatagcccaataaaatagagtaagaattatccctattttacaagtgaaaaaaactgatgctcaaaatgttactcgatttgcaagatcatactacaaatcagtccagattataatccaagccctctaaatctaggtcctattgtctttctaccacaccatggaagccacctccttaattactagaactcttcaaggggacaacaaatgttcaagattgtcaatgcaaagggaccaggccaaaaggcagaatccaggaaagaggcaatatcagagatggcaatcaaagcaaaaggcaacaatctggaatgagttagcaatctagactactttatagcattgccacacgcctttttgcctttgtttagttctaaagtaaaattgctttatagatttttcaatgaaatttaaagtaatacatgcttattgtaaaacaaatcattcataatgaaaaattatacatgaaagagtgaagctttcctagcctcggtcccacattcagtgggtgtacttccagactttgtaatacttactctacttgcctgatgactttctcacgataaattcataaatgagaaattgtatacaccaaagagtatgcctacctttatctttctttttctttttcttttttttttttttttttgaggtggagtctcactctgttgtccaggctgcagtgcagtggcacaatctctgctcactgcagcctccacctcccaggttcaagtgattctcctgcctcagcctcccaagtagctgggattagaggtgcccaccatcacacctaattttttgtatttttttagtagagatggggtttcaccatgttggccaagctggtcttgaactcctgacttcaggtgatccacctgccttggcctcccaatgtgctgagattacaagcatgggccaccgtgcctggcctaaactttctaagtattgccaatgttgtctttaacctgttcacagtgatcagagaaatgttttttcatatgagaatgtgatcatgttttcctcttccttaaaaccttcaatagcttttcatgttcttctgataaagttcaaaattcttaatatgatccaaaaggctatgcatgatctgcccctacctccctctgtatcccaccactaatctggcaggccaggtctcactaacagctgaacaggaaggcctccatgacaactgtttcagcactgactgagtggttaaattaaatatttaaagctgatagagccagtgcccttatacgaaggctggaatgtaacgaaagcccaccaagagttttgcctaggcctttccagggccttgaagcatgatgaaataacaaaggaattcttaacagaacccgtttagtattaaacaggttttactgggggtctgaaggaactccccagacctccacaaacaagttttattgaggtctaaaggaactcccaaatcttcatgatttagcaggagacaagataagcgtaatcacccctggcacctggatccatctagattgagtaaatttactgaagctccagaggaaggtcttcaggactcagaccttaggtatagatgagaagaagttaatcacttatgtctttagatgaatgcacacttacatgtagacatacagcttagaaggtatataagctctggaaaactttgtaattttgagttggtctggcaatattttccctggccttctccctgtacccgtttacagaagtaaattctcttctttcccagttggtctgcatcttgttattggaccatgagaataagcaacccgacccttggtttggtccaggaacactaacactattcctctcctttgcccataatgtttaaacacactgagcttccctctttccctcaagtataccaaacttcctcttgcctcgtaccttaccttagcacatgtggttttctctggcaaagactattagtcatctcccaatatacagtcccccctcctccttttgtctttagtaacaccttcttttattcttgtatggtactaatactccaacttttagctgggcacatgtattctttgaataaataccacattgtccagtgtctgttgcagctaggtgtgaccacatggctaagtcataaccatgggatataagaagtgctcttgaagtgaataggtgtgcccttcttcctccccttcctcttcctgctgattgaatgctaatgaaatagctggagctggagcatttgtcctgggccatgaagtatccttggaactagaggacctgcacaatggaacaacaaaatagaagaatcctgggttcctcatagaggtgatccctaccagccttggactgcctagctctaagctttagaagtgggagtaaaacaaactctttctctttaagccattattattattttagatgtttttgttatttgctattgtgtcaaaccctaacaaataaattcctttgcttgtcttcatcaggattaatcttattggtgctttaggtataaatataattcacttcctttggaaggccttcttgatgctctcatcaagattaatttcctttcttatatgccttcacagtatcctgcttttctaatagcaattatcacaatgataattttatagttactgtgtgactttggttcagtatctcctatccttagtccataaaagctgcatgattgcagagatgcctgttgggttagctaccaaagcctgatacttggctagtacattgaataacagtttatcacatatgtgttgaaaatgaatgaagagtaaatgaatgaatgaatgccagcttgccctcatagatgttttattagtgtgaacattttcactagttctaagaggaaccaatgtaactataacccagattttaatgtcctttgttctctaactccatttgctcccactgtcttccttccatattcaaaataatgtagaaaacagcatctatttgatttcatgaaagaatacatttatgacaaccattggtgcacaatttacattttaccacaaactctatagcggaggtgaatgggctttaaattgcacagcttaactcctccccctcccctatcaatatttttctccttatagtaataattgggtagaagggtgcttttcatctccccttccaccaagaagaatagaattcttggtgtctatttttgcctgcagactgttttcattagctctttaaattcttctcctctttattatgcaagcaatttcacactaggatacatcttatctgcaaatttgcatagccaatctcattacacaagagatcttacatgagaactattattttgtcaatttaaaaggcaacaactatgtaatagcatgatatatcatattttcctttttacaatcttttaaaaccggggatctaagggcttaatggggcactaagaagaaaacgtgaggtgttaagctggtttacttattccaaagctatgatagtattaatgatcagatagatgataggtcagtgatcatattactcacaaaggaacagactcaaccatcttaaatttagtcctgggagagatatcacatgccacagttgaatatattagcaatgatcagaaaacctactgttaaagccacagttgaacatattagctatgatcagaaaccctactgttaaatacgtttctataagcttagtaacactaaacatctgttcaaaattttctgaaaattaccttgcaaggctaccctacactacctttcaccacaaccatttgttccatgttagtaaaattcacaaaagctgcaacatttaagtctgctgaaaaataaaatttctctaagattaatttggagttagctgtgaatcctgtactgcatttatatctgcaaggaaaagaaaggaagaagaaaaacaagtcttgatgccaatgagtacactgagtacatctcctagtatctgcactctgaaatgacgttactatgtatggtgatattttaaacttgaggatttgccagtgccaaatgtatttcacatttattgaaggacagaattgctattaaagcaattgttttagttgcaagaaatattgaacaagaaagtaaggatagtctttctctttttaatagtacatgagacattacaattcctctgaaacgcttagttccaacacattatgttcctgcctgctgtttacatatttgacatcctttgcataacatcaggaaacttcaaagaacatattttgtttgctattctacttatatacaatcaatttgaacgtttttattatctctcaaaacttttgttcatttatctgacccttacctagtaattaatactgtttattatttcaatattagaaagagctaagtctaaactgatgccaattttatgcacaatacgcagaagctaatttcaaaaaaaaatgttaaagtcaccttagaaagtttaaactttttttttttcaacaagacagtacagaaggcaaaatgtataactttgggaaaactaaattatcctccatgacagatcattttatatgaacaaataacatttttctaaaagtttacttctttgttttaaaataaaattcattaaagtcttatttatatacctaacatgaacccattttatatatttattttttgtattggtacaaatctttaatagaatttttatttaaataggggattcttatgttactttaatgcaaaatagaaagaaaacaaatgaaattttatataaaaattaaaaacctaagagtaaaaaggtagatgtatgtagaatcctccacagtcagcgtacagtatggcattttcaaaaagctgagggaaaaggagcaagaaactgagaaggaagcaaaggagaagaaaggggagagtaaagaaagaaagaaaagatgacatgcacccattttaaatgtacatacctgtgcattcaccaccacaatcaagatacagaacatttccatcaccgcaaaaggttaccttgaatccctttcctatcaatatttccctactggtagccccagaaatcttttttctgccacaatatagtagcatatacactttatgtttggcataagttttctgtaaagcttattaacactaaacatctgtttaaaattttctgaaaattaccttgcaaggctaccctgcactatcttttcaccacaaccatttgttccacgttagtaaaattcactcagcctaatgtttttgagattcattcctacttttgcatatcagtagtttattcctttttaatccaaagtaatattccattgtatggctataccaaagttttgtttatacattcatctatttatgggcatttggttgttttcagcttgcggccattacgaataaagtcgccattaacattcacattaaaatctgtgagtgcccataagtttttgtttctcttgggtaaatatcgaaaatgctaggtcacacggtaaatgcatcaaactttttaagaaactgctaaagtgttttccaaagtgtttgtaccattttacattcccattcattgtgtcggagagtttcggtagctccacattcttggcaacacttaattttagttattctaatgggtatgcatgtagagttatcgcaatagtatgtagttatcaaatggtatgtagaattatcacaataatagtacttttaatatacatttctgccagtgctactaatgtgctaaatatcttctcctgtgcttagaggccatttaccttcttctttggtgaagtacctttacacatttttattaggttgttcgacttctttttttttttttagacggagtatcactctgttgcccaggctggatggagtgcagtggcaccatctcggctcactgcaagctctgcctcccaggctcacgccattctcctgcctcagcctcccaagtagctgggactacaggcgcccaccaccacgcccggctaattttttgtatttttagtagagacggggtttcaccgtgttaaccaggatggtctcgatctcctgaccttgtgatccgcccgcctcagcctcccaaagtgctgcgattacaaccttagcgtgagccaagtttctttgacttcttattgctgtgttgtaagagtattctttttaaatattctatattctagacatacctcctttgtactgttggtgaatatataagaaatctttgcctaacacaaagttaagatattttcctatattttcttccataagtttaagatttttgcttttacattttgatctttgttctatattgagttaattttcatgtacagcatgaggtaaaggttgagatttaagaaacctatttttttaatatataagtagaagtagtcagccccattacttgaaaagattatcctttccccattgaagtgccctgcagtttttttgaaaatcaattgaccatacgtgtatgggtttatttctgaattctactttgttctattgacctgtaaatctcttcttatgtgaataccacattgatagacgtttataagcctggaatcagagaaacctccaaatttgttcttctttgaaattattttggctattctatgttctctgcctttgcatataaattttagagtaagctgtcaatagctgaaaaattagcctgcttggattctgcttgggattgtagtccatagtacaatttggggagaacaaatatctaaaccacattgtccttcatttcatgaacatgatggtatatccccgtaggtattaggttttctttaatttccatcaacaatatttttatagtcttcagtgtacaggtcttgcccatatcctgttaaatttgtaggggtaaatttgtaggggtggtatatctttgcacgtattaggttttctttaatttccatcaacaatatttttatagtcttcagtgtacaggtcttgcacatatcttgttaaatatgaaggggtaaacacacgtttcgtgtttctggaaaatctttcaaatggtattattaggttaatttaattttcttttccctctagcactattggggcataattgacaaacaaaactgtacatatttaaggtgtatggcatattattttgctatatgtataattgtgaattaccacaatcaagccaattaacatctccatcacgtcatatagttactatggggtgtgtgtgtgtgtgtgtgtgtgtgtgtgtgtgtgtgtggtgaggacacttagaatcaactctcttagcaaatttcaagtatacaatgtgatgttattaactatagttaccatgctatgcatttgatctccagaatttattcatcttataactgaaaatttgtaaccaaacttcaaatttgtaccaaattttaaaattgaattttcagctgagtgcagtggttcatgcctagaatcccagcactttgggaggtcaaggcagatggatcacttgaggtaaggagttcgagacaagcctggccaacatgatgaaactctgtctctactaaaaatacaaaaaagtttagccaggtgtggtggcacgcacctgtagttccagctactcgggaggctgaggcaggagaatcacttgagcccgggaggcggaggttgcagtgagccgagatcatgccaccacactccagtctgggtgacagagcgagactctgtctcaaaaaaaaagaaaagaaaagaaaagaaaagaaaaccctgaattttcagttactgatagttcctcatgtaaaaaaaaaatttgatttttatgtttatttactttgcatcttgcacacattttaggtctagttgctttcctatagatattttaggattttctatgtaaatgatcatatcacctgtgaataaagagttttacttttctctttaaaatctttatgcctttattttctagcccttgtcttactgcactggccagaattgccagtacaatgttgaatacaaatcttaagtgaaaagcattcagcctttcaacattatgaagtataatgttagttagctgtggcatttttgtaaaggctttttattataaggttgagcaaattattcctattctcagtttactaaaagtttgtatcatgaatagatgcttttctacaatgactgatatgatcataaggttttcttcctttattctgttaatgtggtaaaatatattaattgattttatctgttaaaataaccttgcctttctggcatatatcccacttggttgtaatgcaaaatttttaagtgtatgccggacttgatttgttactattttattgaggattttgttactgtgtttatgagtgatattgatctatagttttccatttgtgaaatgtctttgttatcacagtaatgctgacttcatataataaattgggaacaacccttatcttttattttctaaaaggatttcaccagtaaaccacctctatgtaaagtttccttgtggggaagaatttcattatgatttaagcttccttaacataggattatttagattttatatttcttcttgagttacttttcctaatttaggtctttcaaataattcttccatttcatctaggttgtcagttattgctacaaagttattcatattgttcctttattattctattcattctcctggatctttattcatatcccctcccttttatttctattggctgtttatattctattttactgatattgattttaatcattctcactttgggtttaatttcctcttttatctcattttttttaaatgtggaagcttaggtctttcatttaagacctttctccttttcctatataagaactgaattctatgagactcctaagcactgcactagctttacctacaaagtttaatattcttggttcttatttgcatttagttaaaaatattttctaagtttctttgtgactttagcaactagattatgatgtatctttgtctagttttctttgtttttgtcatgctttgcatttgttgagcttcttgggttggtgttttcattcaagttagaaatttttcagccattgtttttgttatttttttttgttattctttcattcctaacccctcctctccttctgaatctccaattacacatatgtttcattgcatgatattttttcacaggctctgttatttattttagtcatttttttctctgtattttattttggctactttcatttgcaatattttccatttcaccaatcgttccttctgcaatgacagtctgctgtttattgcatctactttatttttcatttcagatactgtctttttcatctctagatgtttcctttgaactcttttatatctacatttctctattcatgtcacctcttcctttaaacctttgagtatatcaagcatatttatagcaaatattttattctctcatatacaaattctatcaaatctgtaattccaggcctatttttattgactaattttttgcatgttcatgactttcattttccttattttcatgtgtagtaatttttttaagagaaggcttctcactctgtcacctaggctggagtgcagtcatacaatcatagctcactgcagccttgacttcttgcactcaaatgatcttcttgcctcagcctcctgagtagctgggactacaggaatgtcccaccacacttggctctgagtgtagttgtatttctttaaaaattactggacatcgttgtggcatagagtaaagttatctggagatcagtttaattcattcaaggcttgcttttactttttttttttaggtgggtctacagtaacctttactctggagctaacttaaccccactgttaagacttacgttccctctggaatgtctagtgaatgtgccatgtattaagcatgatccctctacttgggctggtagttacttgaatgattgttggccttgtgtgagctccagggatttttctgtttatgtatctccagtattgttctttctttggaggtttttctttttctgtcttcatgaagtttcactcttgtgcagattgatattcaactgaagatacaaagataactttaggttgttttctggacctcttttttggtatagtaccctcttttctgttcctctgcctgaaaattctagctgactcagccttccccaactctagtttctgtactttcaactcagaggattacttgaccctgtttctgtttttctacctggcaccatatttaggaattggattcaggcaaaaagctgggtgatggtagggtttgcctcctttgtatcttttctattagggatcacagtcctgtcttttatccaggtctgatcatgaatgtttgacatatttttgtccagtattcagcagttttcagaaggagccactccataccctattacctcatggaagtttgacaaaacctttaaaggtttgacaaaaacactttttaaaagaagacgtgtattattcatatctgtttctccattttagacctttcttcacttcttaccggctaaataatcccatttcctctattttgtacaaatccctcaaacatattaatattctcttcctccacactgttaactgcacatttatcacataaagttagtcttttctttccatcatcatgcttgtcttgccaatttcctaattcataataaatagatggtcctaggaaaacaatctcacctgtaatatgagagttattcaattaattttttgcatcagtgaatacacataccttttacaaccaacctgaacttcctgtgtgcataatttcattgctacttaacttaattaaaaaattattgtttatgcccaatatttcaaataaatttatttaaatttattaaatatttattgattaaaaactactgtctacaaggctgaactctaggatgagggaagaaaaatataagtatgtcataaactctgaactcaaggtgtaaagacacatatctatacataactagacagtaaaactagaccaaaattataagcattacagagatactaaaacaaggtattagaaaacataaagaggaagcaaccagggcaagtagaggagagaattcacagagtgtttgcatttgagcaaaagcacctcatgagataagaattctgacagagaaaaggggagatgggaatgaggcacagagtttgcatgattaaggcagtatgaatgtgcttgctgtgtctggcaaatgagctattaggaaaggcatggtggggagatggtacatgaaaaataaatcagggctctattatgtaaaactgatagtttaaaacaagttcaacattagtcaaggcacaattttctacttcttattctactgagatcaaaaaatagaaagcttctacgtattagatacaaaaggattcagagactgtttctcttctctaaattcccataattcagatgtttggacaactcaatctattgttttgaactattttctggagattgcatgaagtatatcttatctctgtaattgcaagaacaatattttctattatttgtgtatcctgcaagatgactagcacagttcagggcacatcatgtgtatatacgttttgattagacaactcttgctctttcacatgttctattttgtccttagatgactataaaatagaaatgctttcagtgctgatgtttacgtaaatatgtacttgtatgcatgtgtgtgtgtatattggactgaaacagaaattaataggcatgtttgatcaaaaaaatgtgaagaagtctctcaacagccccgcaatcaaaagataaacacccccattattaaatagcaatattttatccttttcaatatacaacatatattccctgtcttttctcatctttatattgtatacatattatttctatcatattttaagccattttctgggaaagcagttgttcagttacatgaaagtaaaatttgggagaaaaagtatataattaaaatgtatattaactaagtcatgataaatcatcaaaacttaggactgaagcattttatattgaaaataaaatgaatataaattagacattaagtctgttagatcagaagtctgttagaactgactaactctagttcacgacactaaatcaaggtagcagaaataaagtagtatgtggtactactccagatattgccaaatttaaaatgcttcttttgtatgctcaatagcattcagtaaattttttttggttgaaaaatttattaattaacgctagccaaagaaaataaaacctgatgttttctcccccaccccaaataatctttaataaacatattaacaatgctgagtgattttaaaactcttttcttttttgagataaaattttttaagtggaaaagaatttttcagatgtaccaagacaagttcaaaaacatggcaatatccttcaacctatgcaacattctcaccatcttgtcagcatttaattaaatctccctgacccaggttcaaatgccagaattggaatacctgaaccacatcctatctagccaaggcattaaacccatgctggataagtcttctgtctgagataatgaagtaggaggtacccaggacaatcaaagacatcagcaacttctgacttaccaggtttactgttaattcattccccatttcttcactttgatcttcctaatggtgaactaatttcatcttcaagaaaaggaatttttctactcttcatctatggatttccatatctgaaaatccctttcaaatacacgtaactctgaccaaacagaactactccaaacatatctgaccctgtgccactaaatctgtcagttacaacatcaccagggaatgccatcctgtcattgcataaagacaaaacctcttcctgtggcagcctgcagctaataactggttgaagaagtgcagctacctcctccaaactgagaacaattctgaaaggtcaccccagcttctgagttcctgtgatgttggtcaagcagaaacagatcattcagtggacagcacctacagaaaccttctccagtaaggtgtgaatcccaaccttagggagaggtgctctcttccatgattgtccttccttggatactctcccccagccatagaatacctttatagtttgttttacatatttatagttactctcctatcatagtttaataatctttggtgttaaactttcttgggaaacttcaacacagaaatataagcaggaaatgataagaaaagaaaaggctaatgttgagccaaagacacaataaaactggttgaaataagaaaagaatacattatgaaatttaaactattttgtctctaaaagccaaactgattttacataaaatcaaattagtgttttggtggccaaattggagacattcaccaaaatccataccctcaaaaaggtcagaaaacatggtgtatcaaagaaatcaagaacactgatctattctaagaccatataatcttaggtgaaaaagcctgagcagagaatacaaacgaaataatcaaaaatataatagaagaaaactttccagaatcaagaaagatgaggtatacaacaaatgcctggaagaactggaaaataatcatatcaagacatactcaggcaaaatcttttaattccaaggaaaaagaataacctatccaagcttccagaatgaacactcagattgcctactgtactagccaggattcttagaggcaaataatagaaactgactctgttaagtaaatcagatactttgtttttacatcccaaacatccagaaaacaaagaaaatttaaaaatcctgaagtccaccatatctatgccaagaagaaaaaatattatgttgaccttatatttttggaacatatgcaatataaacaatagtataagcattatatgacataaaatgtcaacagactactcaaggtacaaggttataactcaagaattttataccaagaaaagttactggttatgtttaaaagcaagacagataatgcagtcctcatgaataattcttgagataatacatttatcctatttgaaaataaattacaacttgccaagagacaaattaaggaatcaaaaaggtgcaacatgtcatataaagtataattcatgaatattgaaataaattaaatacaaagttttaagcataacaatatttattaatataattatagaatatggttattaatatggtcattattttcagtgaaacaattacatatttatagaactcaagatcagctcaaaattataatttagaagggtaaagtatggcaactagttacaagattaatataaaaatcaacagtctttctatttataagcaaagacttctagaatatacaacaggaaaagaacatgagtcaaaaaatttaaaaatcaaaaattaaaacaactaacaataaccttaaataagaaacgttggtgccctagggaaataaaactaattatgaaataaagaaatacatgtcaagagacaaaggaaaattaatttaaatggagaaaaatgtcataataatgtttgagaaagctgaacttttcaaagatggcaaatcttcctcaaataaaagtgtattggggattataataatttatggatgctttatataagttatacataaagtgagggctgaaactttgtcatattttattatatctaagactagaactgtacataacacacatttgtttaacaataaatactttccaataaatggttaaagtaataaattaatcctagctggacctgcaaggaaagatggcaatatgaatttaaaaaccgctataaaataaaagaaagaagagaagagctaaggaaatgtatgacaaagaatataagtactatgaaaagtaaaacactacaggacttgtgcaagaataatagagtaaatagttctagttcagaactgaatatataatctttattataaaaacacatgaaaaagaagcaccaaagtttataaaaaataagtggattactcaataaactatgatgggaaatgagtttatgtgtctgaaaacaaaacatgcgaattgaagtcttctgtgggaaaaaataggcattttcttttaaaggcatttctactataaatagtagtaaatataatagaagaaatgatttatagacttcatttcattaaaaaaattaacccctgtatttgaacattaatactaaaattctaaaacacgtgaaaactttggaaaattatttacaataaatacaacaaaataataatatccttaatatgcaaagactctatataccagtaagaaaaatagcacggtaaatgaaaagcatacaaaagacttgaaaagatcattttaaaagtagtacaattgaccactgatcatacaaaatatgtttaactactttagtatttatagcaattaaaactcaaatagcaaggagataacatgttttatcaatcaaactggcatgttttcaaaccataatgtttggtgaggggctttgcattgggaatgtaaattaacaaaaatattttgaaggataagttggtagtatgtgtaaagaatctttaaaaagtttcttctctttcagaaattccacttctagttatctatactaagagaataaatgttatatgtatgtgtaatgatattcattattccattgatataaaagcaaataattgaaaacacttaatatttaactgaaaaacactgttaaataaattagagtatatctatgtaagaaaatatttaaagatctttaaaatcatattctcagaaaatatttagtaatatgaaaaattgtcattttattattttaatatgttgcactgttttaaaaagtagtataataaaccctaggaggataaattccagttttaaatgttttttaataaaatttatctttaaatagtgaaataatggcctatttaaattttttaatacttttctgaattttgcaaactttcaatgatcaattcagaatgcttttataatcaaatattactgatgttatatgtgtcaatgaagttatttcacctctaccaatctaacccaaaaaaaggtagatgtgcacaaagattttttactcaaggatatttatcatcatattatatataataaaataaatgtataaacaatctaaatgtttaaccatagaaaataattaaattgtgctacctctgtgtgtatacttttatatattaggatattattactataagtaaaatttcataaaatgttattggcatgggaaaattttcatgaaaattaagaaataaaatgcacagcatgattctgtttcatttttatagtgacttgtgatagggtttggctttgtccccactcaaatctcatcttgaattgtactacctgtaatccccacatgtctttggagggacccagtgggaggtaattgactcatgggggcagataccctcatgcagttttttgtgatagtgagtgagttctgatggtttcataaggggtttttccccctttgcttggcacttctccttcctgctgccatgtgaagaaggacatgtttgcttccccttctgccattgttttaagtttcctgaggcttccccagccctgtggaactgtgagtcaattaaacctcttttcatcataaactacccagtcttgggtatgtcttgatagcattgtgagcatagactaatacactcgcatatataaaaactaagataaaatatattaaaacacatctctgtatgacaggtgaattttcattattcatacatatcctattttccaaattgtctataataagaaaaaacaagctttttaaagaaaaatggaagattattcctccatttagaatcccataatactaagtgatttgttgaaatgttcatcagaatgcagaggcaatcctaagaatttaactgcaaattacagaattttcctatcttcacactttctaattgccaaataatttataaaaataagtaggacttaatttcatgacatgtattaaaataaataaagtaaatggttttcaatttgaaatattccattaagtcttttctaacttgagcttatgaaatgcatgcttgcttcttgtttctttttaggcctttgcttccagaaatgttaaaataacatgattactaaatatatctccaagtttcatacagctactgtgaagtcaaaatctggaaaacaagtagaaaagtggagtacttactgttggcaagaactaccacagatccctaagactattgttctataaatgttaaattataaagtgatacaaataaattagattttaaaagggaggaatggagtaggaagaaggagaatgtgttgtgagacacagtagaacacacaggaagagttgaggtatatatctttattcttactgacatatatcccaaataaatgaaagcaaactcaatatttcatgtattcagattaataacacctatttctaattttaatgtaataggttctttaacaaaaagttttcaaaatatttcaaagggcttataaaagtgaatctttagctttcttctaagtacacttttgcgctcctacatctttcatagcctagacctaatttctagtttctggcctcatctccgtttctaggtcctgctccacagaggtgtgatcaggagggccatgcaccattacaaaattgacatgacttagatcttaaaagcagtaccacttgcccctcctccaaactgtttgtttttttatttttttgttttttttccttaaggctgctcaagaaagtagcaaataatatagcctaaataatatatgatttgttgaggacttttttggaggagaggaaagggatgtgattatttaaaactgcacaagtgggaaacaatttccaaatgcttttcagaaaatatcttgtaattagattctcttttaaaactactaggactttgaagtaaaataatgtctgctgctgagaacactgttgaattgcagttaactcctactagtgatcaaaatgacccagtcaaatctccagctgcttatgtaattctgaataaattctccattttttaagaaggatacaccaaagaaataaagttcagtttgtagtggctcacgcctgtaatcccagcactttgggaggctgaggctggcagatcacgaggtcaggagatcgagaccagcctggctaacaccatgaaaccctgtctctactaaaaatacaaaaaattagccgggcgtggtggcacgcgcctgtagtcccagctactcgggaggctgaggctggagaatctcttgaatgtgggaggtggcggttgcagtgagctgagactgcaccactgcattccagcatggacaacagagcaagactccgtctcaaaaaaaaattttttttcagttaaaagatacccactaaaacaactctgtcttggcaaaaattgcaacacttcaataagggagaatatttggcatgctccattcattactctgttgtggtgtaccttacgagagacaaccaaataagatagaacaaaatctatgttgagaacttactgttctacttaacacaggagtggagtacatactgttaccaagaactgccacagagccctaagactatagttctataaatgttaaattacaaaatgatacaaatcgttttcatgattccaggaagatggcagcctgtgtctgtattctctattccttctccttcctaagtccctggtgtggctacttttcctagaaaataactaagtgtactcttggaggctagaaagaacctggaatcatctgagattttaagtcctaaaaatgaagatataattctggcctaaaacttactggacagtggtcagaaccccttctaggctaacttctcctacataacttggaacaaatgtcacagattcccggataaccacaagcaaggagagaaaattctcctacctgtttactaagagagcccaagtgtccctttacactgtagtgttgggctaagtacaatccatccctgggctaagtacaatccatccctgattgcaccaaacttaaaaaaaaatctctttttctaagcctaaatttcactaaaagcactctggagctaaacactcccatttaattatttattgttgtttaattaccattttcttagagactccaaaacctgagcagtacaggtgttgacagatcccatgtccaataatatgaatgcccattaatatgaacaataaggatcaacaaaccattttatgagacagtggcttaaaagaagaaaacttagatgatcaacaagagtagtagaggtaaaaataacagaggacacacaaaaaaatggggaaaaatgtactataatctcttataaatatgaaattagaatgtgtaaaaacagtgtctagaactaaaagaaagaactcttgaattttaaagttcagttgagaaaatgaaaacgtcactgaagaaaagtaattttgtgttttagaaaatcaagtgaagaaaacagaataaaaatgaaccctgataggtatcaagtacagattaaacatttgtaagttggtgaataatgggataaaaacaaatgaagatgtgatcaaagaaataataaacaaaagctctcctcatctgaagttacactcagattaaaagagctcacttgttaaataatttaaatggcacgtatttaaagataatctgatgatttttgaactctaaagttttgttgttgttttgtttgagacagggtctggctaggtcacccaggctggagtgcagtggcaccatctcgactcactgcaacctccacccccaggctcaagccatcctcccacctcagcctcccaagtacctcggactacaggtatgtaccaacacacccagataatttttttttattttttgtagaaatagggtttcactatgttgcccaggctggtctcaaactcctgacttcaagtgatccgccctcctcggcctcccaaagtgctgggataacaggtgtgggctaccatgactgtccgaactctaacattgaactggaaatattaccagtttcaacaagggaagagaaaagcagatattttcaaataaaaaagaaccaaattattatcaaattcttaactgtaacatcagaagttagaacacaatagaccaaccattgtagattatggaagaaaataactgttaaaaataggcagctggacttgaaatcctgcctaaatatgggaaatggcagacaggagtcaggactaacttgcagcacccactcggatggagagaacagcatgtggagactcacattgtaaacttttgctccaagaactgccataggaacataccagaaaaactgaaagaattcacagatcctttgaaagaagcaccttgttactgcaaactctgtgagacagttgaaaaaatgtcttgaaaagtgtgaaaggggaaaatctgcctccaaacacacatcctccttggggaacctgaaaatccagaccacgggagaaggatttaaacttatctagagctgaaacaaatttagacagccaagcaaaatacaaaagtagaagaagcaggccaggtatggtggcccatgcctgtaatcccagcactttgggagacgaaggtgggtggatcactcgaggccaaaagttcaagaccagcctggccaacatggcaaaaccccgcctctactaaaaatacaaaacctagccagccatggtggcacatgcctataatcccagctggctgggaggctgaggtgcgaggatcacctgagcccaggaggcagaggttgcagtgagccacgatcacgccactgcacaccaggctgtctgttaagactctgtcaaaaaaaaaaaggaagaagaagcagcagcaggaagagccctgtaggcagtctcaggggagccatttctgactttatctcacaggggtctgtgggagggctgcaagtggaactggggaaggaccacagggagaaagaaacttccagctgaacttctgtaataattttgaccaagcatgaattttcctgggcagaatcgggggagggggagaataggaagtgtggacataaacacagaaactgcggcaggcagggaggggtgaagcctgaaatccctgcttgctttctcagctcttagtgggtaggcttgtagcctggtacaagatctcagtactgctcacaggctccctgtatataaactcagtgctattggaggggcgtggtaagagttagactagccttactggctgcatgggagctgagtgaggcccgtcactgccagcttttccccacttccctggtgacctgtataatgtacgagaggcagccataatccccctaagaacataactccattggcctgagaaccacaatcccatcccccacagaagccatagcaagtcctgcccaaggagagtctgagctcagacacacctaacccggcctccacttgatgatttttctccacctgccctggtagccaaagacaaaagacataatctcttgggagctccatggccccactcatcacctgagaatcctgagtacttatccaggcaaccttaaagcaagcttgtatacccctatactatgcagttgatctctcctgaaagtgccacctcctggctagaggccaaccaactcaagccattacagcaactcataaaagaacaaacccactccaaagaagaagaaaacaacagctaattccactgcctgtagcatcctagctaaccagaggtcctgagtctgtccatgtgacaacttcactgctaacacaactagcattgagaaaaccagaacaataaacaaaattacaaccaaggacactcacggagtccacttcacccctctgctacctccactggagtagctgctggtatccacagctgagagaactgaaaatggatcacatcacaggactctttgcagacactccccagtaccagcccagagccaagtagctccactgggtggctagacccagaagagaaataacaatcacagcagtcaggctgtcaggaagccccattcctagaggaaggggaagaacaccacatcaagagagcaccctgtgggacaaaagaatctgaatagcagctctttagccccagatcattcctctgacatattctacccaaatgagaagaaaccaaaaagacaactctgctaatatgacaaaacaaggaccattaacacccccaaagatcacattagctcatcagcaatggatccaaatcaagaagaaatctctcaattgccaggaaaataattcagaaggtcacctaacacataaggactcacataaacttaaggaaaaggggtggaaagagatattccatgcaaacagacaccaaaagcgagcaggagtagctattcttacataaggtaaaacagactttgaagcaacaaaagttttaaaaaacaaagagggacattatgtaatgataaaaggactagtccaacaggaaaatatcacaatccaaaatatatatgcagaagttcccaaatttataaagcaattactactagacctaagaaatgagacagacagcaacacaatattagtggaggacttcaatactccactgacagcactagacaggtcatcaagttagaaagtcaacaaagaaacaatgaacttaaactatatcctataataaatggacttaacagatatttgcagaacattttctatccaacaactgcagaatatacattctatccatcatcacatggaacattttccaagatagaccatatatgataggccacaaaacaaagctcaataaatttaacaaaactgaaattatatcaagtgctctctcataccacagtgcaataaaattggaacaaaaggaaccttcaaaaccatggaaatacatggaaatgaaataatctactcctgaataatcattgggtcaacaatgaaatcaaaatggaaatttaaaaattcttcgaactgaacaataatagtgacacatcctatcaaacctctgggatacagcaaaagtggtgctaaaaggaaagttcatagcattaaatgcctacatcaaagagtctgaaagagcacatatagacaatctaaggtcacacttcaaggaactagagaaagaagaacaagccaaacccaaacccagcagaagaaaagaaataaccaagatcagagtagaactaattgatattgaaacaacaacaacaaaaatacaaaagataaatgacatgaaaagctggttcttggaaaagataaacaaatcaatagatcattagtgagtgtattagtcccttttcatgctgctgataaagacatacccgagaatgggtaatttattaaaaaataaaaaaaaaggtttaattgactcacagtttcatctgactggggaggcctaacaatcatggcagaaggtgacatacacgtcatacatggcagcagacatgagagaaagagaatcaagtgaaaggggtttccccttatgtaaccaccaggtctcgtgagacttatacactaccatgagaacagtatgagagaaactgcccccattattcaattatcacctactgggtccctcccacaacatgtggaaattatggaagctacaattcaagatgagatttgggtggggacacagccaaatcatatcagcgagattaaccaagaaaagagagaatatccaaataagctcaattagaaatgaaatgggagatattacaatagatatcacagaaatagaaaagatcattcaagactacttgaacacctatatgctcacaaagtagaaaaacctagaggagatagataaattcctggaaatatacaaccatcctagattaaaccaggaagcaatagaaactctgagcagatcaataacaagcagtgagattaaaatgataataacaaatcgcaaacaaaagatgttccaggaccagaggaattcaccgctgaattctatcagacattcaaggaaaaactggtaccaatcctattaacattattccaaaagataaacagggaatcctccctaaatcattctatgaagccagtatcaccctaataccaaaaccagaaaagggtatttgaaacaaaagaaaacaaaaaaccaatatcccttatgaacatagatgcaaaaatcctcaacaaaatactagttaactgaatccaaaagcacatcaaaaaggtaatccaccatgatcaagtgggtttcataccagggatgcagggatggttcaacatacacaaataaatgtgatacatcatataaacagaattaaaaacatcatctcaatagacacagaaaaagcatttgacaaaatccagtatccctttatggttaaaatcctcagtaaaattggcatagaagggacatatcttaaggtaataaaatccatctaagacaaacccacagccaatattatactgaatggggaaaaagtgagagcattccccctgagacctgggataacacaaggatgcccactctcaccaattctattcaacatagtactagaaatcctagccagagcaatcagacaaggcacagaaataaagggtatccaactcagtaaagaagaagtcaaactgtcactggtcaccaatgatatgatcatatacctagaaaagtataaagactgatccaaaaagctcctagaactgaaaaaatgaattcagcaaaggatcaagtgacaaaatcaatatatacaaatcagtagcactgctatacaccaacagtgaccaagctgagaatcaaatcaagaactcaactccttttacaacagctgcaaaaaaaaaaaaaaaaagggaaaaagaaatacttaggaatacatctaaccaaagaggtgaaagatctctacaaggaaaactacaaaacactgctgaaagaaatcatagatgacacaaacaactggaaatacatcacatgctcatgaatgggtagtatcaatattgtaaaaatgacaaatctacaaattcaccaaactagaaaaaacaatcctaaaatttatatggagtcaaaaaagagcctgcatagccagagcaagactactccaaaagaataaatctggaagcatcacattacttaacttcaaactatactataaatctgtagtcaccaaaacagcttggtacaggtattaaaaataggcacacaggccaatggaacagagtagagaacccagaaataaagccaaatacatgccggcttgatcttcaacaaagcaaacaaaaatataatgtggggaaaagatatcctattcaacaaatagtgctgggataattggcaagccacatgtagaagaatgaaactggatcctcatctctcaccttatacaaaaatcaacccaagacgaatcaaagacttaaatctaacacctgaaaccatcaaaattctagaagataatactggaaaaacccttccagaaattggcttaggcaaagaattcatgaacaagaacccaaaagcaactgcaacaaaaacagagataaatagataagactcaaactaaaaagtttctgcacagcaaaagaaataatcagcagagtaaacagacaacccacagagtgggagaaaatcatcacaaactatgcatctaactatataaacaaaggactaatatccagaatctacaaggaactcaaacaaatcagcaggaaaaaacaaacagtcccatcaaaaagtgggctaaggacatgaatagacaattctcaaaagaagatacacaaatcaccaacaaacatatgaaaaatgctcaacatcactaatgatcagggaaatataaaccaaaatcacaatgcaatatcaccttactcccagaagaatggccataattaaaaaattaaaacataatagatgttggcatggatgtggtgacaaagggaacacttttacactgctggtggaaactgctagtacagctactatggaaaacagtgtggaaagtccttaaagaactaaaagtagatctaccgtttgatccagcaatcccacttctgggtatctaccccgtgaaaaagaagtcattatatgaaaaagacatttgcacatgcatgtttatagcagcacaactggcaattgcaaaaatatggaaccagcccaaatgcccatcaatcaacaagtggataaagaaaacgtggggtgtgtttatgtgtgtgtgtgtgtatacatatatatatatacacacacacacatatatacacaatggaatactactcagccataaaaaggaatgaaataatggaattcacagcaacctggatggagttggagaccattaccttgagtgaagtaactcagaaatggaaaccaaacattgtatgttctcacttacaaatgggagctaagctatgaagatacaaaggcataagaatgatacaatggactttggggactccagggtaaggggtggggattgaaagataaaagactatgcattgggtacagtgtacactgtttggatgataggtgcaccaaaatctcacaaatcaccactaaagaacttatccatgtaagcaaacacctatttcccaaaaagctattgaaataatacataaaataatagtaattttaaaaataagcagaagaccattagtcagaggctgtctctgcactatgagttgctacatgatgaaccataacctaatttggtatgtaaacaaaccaaaatgtaacttaggagtataacagccaagtttcagctaatcacaagcagccaggtttcagtcaattataggcagccagcttttcacaacatgcccaaataaggcaaaagccttatcacactatgcccaaataatataaatacctcattgtagccaatcagatggtttctcgactttgcttccatgttgaaccaataaaagctcactgctcatgctgctgggcagagctctctgaacctcttctggttctgagtgctgcctgattcctgaattggtctttgttcaattaagctacattaaatttaaattgtcttaagtttttcttgtaataaaactatgaatcaagaatcctattaccaagcaagatatcactcacatgtaagaaaataagtatgacaattatagacatgtaagggttcatttacattatttaaaaattactctaaaaagcattttaagtaactcaaaccacttcacacatactatgaaaaccttagaacagtatactttcatttcctcctatcatttttgtgctgttgttgccatatattttaagtgtacatgttagaaatcacacaatacattttattatttttactgtacacagaagattttaatctcctttaagaagattaaaaacaatgagacaaatttctcttacatttatgcacctatttatcattgtggaacctttcattttttggtagagcaaactttccatctgatatcatttttgccttttgcctggataacttcctttaatctttctatgagaaagatgtgtttacagtgaattctgtctgtgtttgtctgaaaagcttttaccctaccttcacttatgaaatataatttaaatgcaaataaaattataacttgatagttttttcttttagtgttttaaagatatcatttcatcacttcagactcacagagtttataagaaaaagtctggttttattcttttatacatagtactctggtaagtaatataccttttttctctggctgcttttaggattcttctttacatcactgattttcaataattttattttaaatatgactcaatgtggctcctttaagtttattttgcatacagtttattcaacttattggatctgtgggcttagagtttccatcaaatgttgaaaattttcaaacattattttctcaactaatttttctactttcttccctccctttcaggatgtcagttacacatagcttagtggctgagttggtcactgctcactgatgctctgttctattttttttcaatccttcttctttctgtacttcattttagtttctattgctagatcctcaagttcactaatcttttctgcttcagtcctatctctgttattaatctcatctagtacacttttcatttcagctatcatattcattatctccagaagttccacttgagtcatttttttcttacacttctctcctcatgctcatgtatccctttatgtgcttgagcattttataacactgttttatatatacataatataacagctattttgtaaacagctttgctgctaaatctattgtctctgtttctactgatttatttatttttctccaggttatggcttctttacacacaaaataattttttactgtttggtgaacattgtgaattttacattgttaggtgccagattttgttatattctttataaccaggacatagttaattaatatgcagatcagtttcattactttgaggcttcctttaaactttgttaggataattccagaacaatcttttttcaaggccacattatccccattattaaggagagactcttctgagtactcttccagtgccttgtatcttacaatttaggtctcttcttttcactgttgggaatataaaacattccccactctgtgggagctctgagaaccgctgagtattgcttttcagtgggtccttccccagcctcactgtgtgcagttcccacctctccaataccctgagctacaaatcctagcaaattcaagctacctgaaatctaaactctgtctcctcatcaagaactctctccctgctttgtagtctataaaccaccttcaaacacataggtgggtaattgtaaggctcacctcatttgtttctcttatctcagaatttacagacatgtatcgcctaatggccaacaactgaaaacatctgttttatatactgtgtccatttttctagttctttacagtggaaaggatattcccaaaataacaaatgcctcttgatgagagactgatcgttttcggaaaatatcaatataaagaaaaaaggcaccaaggactgtgtctcaagcctgtaatcctagcactttaagaggctgaagtgggaagatcacttgaggccaggagttcgagaccagcctgggcaacataacaagacttggtctctagaaaaaaacatagccaagtatagtggtgcacacctgtagtccaaactacttagaactacttagaaggctgaggtggaaggattgcttgagcccaggagtccaaggctgcagtgagctatgattgcaccatcacaatccagcctgggtgacagactgagatactgtctctaaaataataataataattacatgagcaagtgctaaatttaaaaaaaaaaaaagagagaaaatgcaagttacaaaagttgtgaatttcttacaagtaatatattttaagggttccattgtgtataaaaaaattacctatgtgatcttggactagttatttagactttttagccctaaaatcatctcaattcaaattttcctcaaactgaagaaattttcttcccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgtagagaaaaatccattaaactacattggctattgattcttttctcctgagaagttccagccagaattcattgctatcactgtcttatgcatggtggtgcctcactaatgaaagattcagatttttttaaagggtctacctggcctaaataagatatgccacttaaaattagattcataataaaccaaacaccgcatgttctcacttacaaataggagctgaacaatgagaatacacggacacagggaggggaacaacactcactggggcctgtcgggggagggttgggggagacagagcatcatgataaagagctaatgcatgcagggcttaatacccaggtgatgggttgataggtacagcaaaccaccatggcatatgtttacctatgtaacaaacctgcacatcctgcacatgtatcccagaacttaaaataaaataaaacttttttaaaagatggtaacaatagacactggggactactagagcgcggagggtggaaggggagcaagcatttaaaaactacctactgggcactatgctcactacctgggtggagggatcacttgtaccccaaaactcagcaaagcacaacatacccatgtaacaaacctgcacatgtaccccttgaatctaaaataaaagttgaaataaaaaataaattaaaaagagaaattttttttaagtagattcataaatttcacaatttataaattaatacatatatggttcgttgttcatctcatgataaaatcacttggaaaaactccaaatgtcattaggaagatacctataagatgatgtagagtcattttatggagtctacgatatattgttaagtgaaaaacaaaagcttcatatcattcctactcgatttcaaggtgtactataaagctacaataatcaagacagtgtggtattggtgaaagaatagacaaacatattagtggaacagaataaaatccaaaaataaacacataccaatacgctcaagagatctttgacaaagtagcaaagcaagtcaatgtagatagcgtttcaacaaatggtgctggaacaactgaacatccacatgtaaaaaaaaaaattagacacaggtcttacacttttcacaaattaattcaaaatggatcataagcctaaatgtaaaatgaaaagctataaaacttctagaagataacaggaaaaaaatctagatagtgttgggtttggcaataacattttaggtgcaacactgaaaacatgatatataaaataaaaattgataaattagacttcatttaaacttaaattgaaaaattctgctctgtgaaagatactcttaagagaatgaaaggacaagccacagacttggagaagatcttggcaaaacacatatctgataaaggactggtattcaaaatatacaaagaacacttaaaatacaacataagaaaacaaataacccaatttttaaaatgggcaaaagatcttaacagctacttcaccaaagaagatatacagatgccaaataattgcatgaaaagatgcgaataccatatgtcactagagaactgcaaactaaaacaacaatgacataccactacgcatctaccagaatgactaacatataaaacactgacaacaccaaatgctggtgaggatgtggagcaacaggaactctcattcattactgtggaagtgcaaaatggtacagccactttagaaaacagtttggaagtttcttacaagctaagcacaatcctaccatgtggtctagtcatcacactggatttatttcatttgagaatttatccaaatgaaaataaacccacagaaaaatctgcacaggaatgtttatagcagctttattcataattacccaaacttggaagcaactaaaatgtctttcagtcagtggaacagataaacaaactgtggtatatccatgcaatgaaaaattattcagtggtgaaatgaaataagctttcaaagcatgaaaagacataaagaaaccttaaatttatattactaagtaaaataatccagtctgaaaaggctacttactgtataatttcaactatatgacattctgaaaaggcaaaactatggagacaatgaaaagatcagtggttgccaaagttctgggggataaagcaagggatgaataaggagaccacaaaaggtttttagggtagtgaaactattctatatgttactgtaactgtggctacatgacattatggatttgtcaagagccacagaactgcacaacacaaagagtaaaaccctatataaacaatgaactttagttaataataatgtatcaatatcagttgaacaattttaacaaatataccacattaatgtaagatgttaataacaggagaaatgggagaggtagcaggtatatgggaactctgtactttctgctaaacttttctgtaaacctaaatttactctaaaaagtaaagtctattaatttttttaaatctataagcaaaaatgtatgcatacatagcatgcttttgattaagaaaaacggggcagaaaacataggaaggataaaccagaaaaacgttagattacctatatggggtgggtagaaagagcagaaggtataggaaagaggtaggatttctctgagtatacctgtttatatagttttgatgacatattaatattttatataataaaaacaaaactaaatcaacaagaatgttgtggaaagtccttataatttgctaaaaacaaaaacatataaacctaattatatatcaaatagataactatatagaataaaataaaaacaaattaatccaagaacgttttgaatacaatactgtttccaccctcagtggaaatattctaaggaccaaaataaccgcaaataaaccttgaatttcacttggtaaatttggtggcattgctggtattgtacagcaatttaagtgtgtgtgtgtccgtgtgtgcatgtgtgttgcacaagcacatgtacatgtgttaaaaatgagtaaataggcggttacactgacactattgggaactgggattttcaccatgaaagaaaggaaatacaaatatggattgaggaacagacagaatttgtggctgaagagaataaatccatgacttaagaaaaaaaaatgctttctaccattacctactaaaaggttcccgaagcaataacactctacagcaaacaataagttcctttgctatatatttaagcctcgggtttatgaatctaacattgcgtcttatctgtagttgggacatgctgtttcattcttggaaaatttctttttcctcttttttacctgcttaatgcttactcattcttaatgtttcagctaaatatgactatttctggaatataataaattaccatcgatttctctccttaaggcctatgatgacttcacactacttaatagatatccagatatacacactctgcccatggttttctttatcagattgtgctggactatcttatctagcttgttttcttcctactgctgttctgtgtgtgtgtgtgggtgtgcacgcacgtgcgcaagcacatgtgcgtgctctttattagctctaacagattttcttatttttcaaatttattcattcacttattttttcattcattcagattcattcaatgacacaggcagtgtgccagtgagtctcccaagttccattctatacttgggaacatttcattgcccccctgccacccacttcacacagacacatacgtgtgtgtgcatgtgtgcacatgtgcacacacactgctgaaattctacttctgtaaattcttcaattaatggaagagaagtcaccatttttccatgtgttttttctttctaaaattgtgccatccatgaatctaccattcaaataacagtgattcttttcataaataattacttacttaatttatgttttgctcagctctatctcttcagtgctgactttcttaagctataaaatcctggagagtaaaaatatatgccttttcatcccctttgcccttagtccagcacctgagaagccgttaagaaataccaacaataataatgcattatgcacagtggttgcacaataaatattgacagaatgaaaacaatacccttaataaatgtgaaagaacagagtcttcttgtattgctgttttaaatatcccgtaacttctggtcaaatctccttacttgctaaacgatacaaaaattaagtaatttgtaagacttgctcaagattttatacttcaggatagagtgtatattcatcaatgcaagtaactaaaatgtagaagagtaaaatgaattttgataaagttattccattttaatttcaacacacaggtgctggcactgataaatgtaacctgaaggtttaattcagagaaatctttgccttcaagcatatttaaaataagctgtttgcattttcctgcatataattattctaaccctgaaagcaccttttaaatatggattacaaatccagctgccttaaaatgaaagtaaaaggttttcctttctcagtctattttgtaagttggaaattaatgtaacagaactattttgagcttagagagttaaaccttctgactaaattcatgcttaattttttaatgtatttgtgagtttaccaaggtttgcacagaagacaacttttaaaatatcaaaaaaattaacaatgcttcatttttttaacattgtaatttttaaaattagtcatctctcctcctagagggatacttcacaaaagaggcatcccttgatcaggcagggtttactcagccaagtgcttggaatgaacccagaggaaccaaaagccctgatatttctggtatttatttgcaagaaacagtagtctccccatacccataggggtgagttccaagacccccagtgaatgcctgaaactgaggatagtacccaatccaactgccatcaataggaacatgcttcttttcatgtattctactcacaaactgaaagcctttgccatattgactaaggatttattacacactgtggctgtaccttttgcagtttgaggtgcaacaacaaagcgagcacgaattttttttccttctttacaatttcatgaatggaagtctcatccctaccatagatcttagcaacctcagcacataatattttttttctttattgagaactttcaccttttcacttaaagcactttacagcttctccttagcatatcccaattgccagcatcattacttttgtagtggtaccacaggtaactgaaaccacgaaagtgaaaccctggataaaggggaactactgtattcccattctaattgctaggatcctgttcctaactggaaactaactttagaatatgctagagaatttatgttctgcaattcaataaaacatgtgattgcccttgacagtctcaggtcattgacttgaagcagaaagttttgcttaatgactacagagcagtcttccaatccccacctgctgaactggtgcttatctcttacttgtaatatcttgtaaggaatgcaagaaacctacaaactctactattctgattatttctacaaaggtgacctttggtgagtacgtggtctaagtcccaagaaacaacacattatagtttaactttgttaccacacttcaataattgtttctcaacctggtatatagaaattctaaccaggctcctgatccattttgcctatttcatatcttagaatctcttggttgtgccaccacttcctgacaccagttgagacactttggggttgcaagtgggtttgcactttggggttgcaaaatccaactcaaactagcttaatcataaactggaatgtattatctcttggaatccagggaaatgctaaacaatagtatatagatgagcctcaataaaaatgaaccaacaacagatatgctgctgctgctttttttaaatcttgtatttttttatttttatgggtacatagtaggtgtatatatttatgaggtacatgagatacttttatacaagcatacaatgtgtaataatcacatcagggtaaacgaggtatccaccacttcaaacattcatcatttctttgtgctacaaacattccaattgtattccctcagttattcacaaatgtacaacatattattgccgactacagacaccctgttgtgctattaaatactagatcttattcattgtatctaaccatattcttatactcattaatcatttccccatccccgcccccaacactaccctttcccagcctctggtcaccatcattttactctctgtccccataagttcaattgttttgatttttagatcccacaaatgagtgagaacatgcaaagtttgtctttctgtgcctggcttatttgactttatataacgtcctctagttccatccatgttgttgcaaatgataggatctcactttttatgtctgcatagaactccatcatgtatatgtgccacattttctttatccattcatctgttgatggacacttaggttgcttccaaatcttggctattatgaatagtgctgctgtaaacatgggagtgcaggtatctctttgatatactgatttcctttcttttgagtttatatctagcagtgggattgctggatcatatggtagttctatttttagttttttgaggaacctccatattgtcttccatagtggctgtactaatttacattcccaccaatggtgtatgagttttcccttttctccacatccttgcctgcatttgttattgcttgtctttttaataaaagccattttaactggggtgagaggatatctcattgcggatttatttgcatttatctgatgatcaatgatgttgagcaccttttcatatacctgttggccatttgtatgtcttcttttgagaaatgtctattcagatcttttgcccatttttaaatcagattgttgtatctttttcctgttgagttgtttgagttccttatacactctagttattaatcccttgttataggggttgtctgcaaatattgtctcccattctgtgggtcatctatttactttgttgattgcttactttcctatgcagaaggttttgtttgattgccttttttttatttgagacagcgtcttgctctatcgctcaggctggagtgtagtggtacaattatggctcactgcagcctcaacttcccaagctcaagcaatcctcccacttcagcctcccaagtagctgggaccataggcatgcaccaccaaacccagctaattttttttttttttttgtagaggcagagtttccctatgttgcctaggctagaagctttttaacttgatgtgattacatttgtccatttttgctttggttgcctgtgctttggggttattactcaagaaatcttcacctagaacaatgttctagagagtttccccaatgttttcttttagtagtttcatagtttcaggtcttagatttaagtctttaatccactttcatttgatttttgcacatggtgaaagacagggtctaatttcattcttctgcatacagatatccagttttcccagcaccatttttgcaatttagatttcattctctttcattataaattttgtttctccacaaggcaagaaacataaccatcaaacatctaagttttatatcttaaagtttctttggccattaaaggaaacattgactctctttctcttgattccagttttaaatttcctgaaaataattctgattggcctgacttgaattagatcaatctgaaatattccattgttgagatggcataaagtggccaactgtcctggtttgcctgaaactaaagggtttcctgggatacaaatgcattgactctgatactactgttgattatttgtaatagtaaatgaaacatcatgtctaatgtattctgtgtgcttcaaatctttttaaaagaaactgaattaactaactggcatccattgctcttctcaaaaatgtttttatattttgactgaaacccaccatgtgttatggttatctcctttctttacgtttcagtatccctgaaacatattatcctgtttcacgcctcgtatctttacatatggtatttccacccctccctccttattcatgtgtcataatcctcttcatttaaactcagctcagacactgcttttgtgaagtcattgtgaatcctgttctcctcccctgggagagttagtcattccctgttttgttctctactcccaggatatatttctgtacttgtctcataattctgttttataatgatttatttacaaatatatctcatcactatcctataaggtatatgaggccacatctttatattcccagtgcctagcgcaaagcctggcataatggcagtatccccataaacgtttgataaatcgaaaaatctaaaataggaatattttaaatttggtttggggcatcaggtatcatgtacctattatttctatgatcagtctctgaataatagccagtatatctggcatatttgttaacatttaaattacaaatgatagcgtatcaagaataatgtgattactaaaaccagtaacgtgatttgggcctttaaagaagttaatttcaagcttgactttgctgtaggcccaaagtttataacttgttcctaaatagaagttaaatgataccaaaatagatgtataaataagaacagaaagtatgaacataatcagccctgttctctgacaggtgggttggaggctgaggatgcatcaaacagtaaggaaagtcctctgtgggctaacgtgggagggataatttggcttcctctctccacaggcagatggaggccttttccccctgcatagtttctgagaatgcaatgaggaaagatgattgggatgctcatgtggaacaagcatactatttggcttacattaaaaaatagaatgaaatgagtatccctagggagaactaacttacccaagacacttcaacatttctagactcatttctctgaaacagtctagaaatagaaatatatacacatattagactacatctagaaatgtatttgtatatgtatttctagacacacacatacatacacatacattacataatatatgcatacacatacatatacacacacacacacacaaactctctaatgaaaactgtgccaatttcaaaagtgaagctaaattatatttcagttatgctcccttgcatcacaaaatgaggctctccagcttaatattggcattcccaagccaggtcaagaaagtaggaactgataagctgtctggtataatagttctctagctaaatctctagaaaggtgctgcatctgacatttcttcaaattagaggaaatttcataagacttggtagggaaaaatatgtcagatgacagatatgtatatcttctttcacttttgcccaaaacgtcattaaaatgatagaaatatatttgtaaaggcataaagacataaagacaagcagaacaagaaaggaaactacagtaacaaaattctggatgctataaagtagttacatgacaaatgactaagcagacttgagaactggatccaaagctagccatagaaaaaactaaaaatcaacctggtaagactacagaggactcatgaattccataccagatatgtctgaaagaataggtgaataaaaaggcaaaaatagcaactatgtgaaagaatattttaaagcagttagattcccatatgcctttctcactctatagcctggtgactatccgtccctcaatcttgcaaaacactgaagatttcttctcttagaagagtaaaacagttctctaaactaatcacagtttagggtatggtaagataatgaaaataggtgattgagaaaacaggtatactggatgttgacattcctgtgtgccctctttccttaaacagccctaagaacttcccattaggagcttaaaagagggatttcctaggatgttccggtcaaaaggaaagatctaaagatgctgttgtcaagacttctccaactaaacggaccaatggaatcaacctaaagcaaagcttatagtgacaatggcatctagaagacaatatggtcattgttttaatttctctagggaatttattctcaacactagaatttcacatccagtctatgaagcaagagtgaggacagaataaagacatttgcatgaaattactgggagatgtgctgcataaaacaagaaaaggcatggcatacagaaatcaagatatccaacaaaggaaagaggcaataaaaatccccaaatgatggagaagaattgcaaggttgatacctatcagaaggagtagaaggtgaccagtccggatttaaatgaatggaaaggctcaggtgagattcttcagagacatgaagcatatagaatacctgatacacataaacatgttaagaaaagatgaatctggaattgtgttgactatatatacatagaaaatcaatcacaattaggaaagacaataattaatcctaggggaaataaaacattgtaatggaaaggaagaggaatcagggtttagcctatggatcagtaacattataaataatgtctgtcgacaaacataacaagtaaatagagaagactaatctaacccaaattttgcaattaatgtgttaaagagatagtcatggaaaacatgtgtgtgcttgtgtggggtactgttatagtaagcggtaggaaagagaggaatgccatattccatagtgggatgtcaatagataatgtctaaaactgaaacattaaaaaggagcaaaacaaatagattagagacataaagataaatacccagataactagataaaagagatgaaggtgttgggaggaagagaagaagatggttggggtactgctttttaaaataataataaataatatataaatatttgacaattcaagtaaaatcctctaaaacttatataatcttgactttatgatattatataatttacctaaattgaatgcatcaattctcacccataattactttttgtaagctcaaacattaagaatttggcaatgtcttataactcgcttctgtgttagggacctatggcagaaaaactctgaaattacccccaattatccctgtttctcatgcctttgtgtaatcccctccccttgagtggaagcagaacctctggtttgtttctagctaatagaatatgacaaagacaatggcatgttaattccatagttatgtcacataagattgtgacttccattttgcaaacataccctctgttgattctctccctttctggctttgatgaagtaagctaccatatggaaaggccatgtggtaaggaactaagggaggcttacaaactgaggctctcggtcaaggaattgaaagcattcagcaaggaactggggtcctccattgacaaaccacaaggaactgaattctgccaacagccatgtgagcttggaaccagatccttccccagtcgagccacagacgaggtcccattcctgggtgacaccttgattctagtcttgtgagagaacatgaaacacaggacccaagccatgcttgaatacctgacacacgaaactgtgagataataaatattttgcataaggcactaaatttgtggtaaaatggccacacagcaatagatgaataaaggatctaaccaaaagagaccatgatttgagcacctctccaactcaggtgttacaaaacaaagattgttgagttctgcttgtcagaggtatgaattctgactgattgcccaagcctccagtttgtttgcatcatccagctacttaagctgacactgctacacctaaggttcagcacggcaacctcagatgacttcattctgggctacgtcatccagaagtcataaaattatctcccaaatattaaagaatttaaacaaattactatctttagcagtgccaatcaaatgtcacccaagaggtaaagtaatattcacttcagtattttagagggaaaagtcataagaggtaacacataatagaaatcttctatttaataaaatgttaagagtagatgggaaaaatcaagtttttcaccctctaaaaagcatacattctaattacaacacattaaatatttaacaaatcctgagttctaggtaaatggaaaggaaatttcctttgcttttaatttagaataaaaggtgatatgtgggtggtgaaatggtgcagcttacagtgcctacattattgtacagaaagaaagggcagcagggagctagaattatagaagcaggaaaaaaatggtatgacaaccaggtaggcagcaatagccatttgactctctacctaccagctctcataggcttcgctgtcttagagttattataactatattgctaaaggaaaaaaaaagtgtggttatttgttacttagctgtccttatcacactgactcagaaatcaggtgtatgtgtgggagaattttcaaaagaaaatccacatacagctgtgaatcactcacctgaagaacaatgagccaaatgggcaatcactgagacaaactgtcacttatcaaaactctataagcaatgcggaggttaacctgggggtctgaatctgtcagtgccaagtttcttccagctgtcacaatcagacaagctgcctccatcataaaataatgcaagccaaattcaactgagtgggactcaaagaaacatctgaaattcaacaacagcagccttgccatctagactattttgtgacaaagttgatgacaaggggttggaaatgacagaatacatcagtatggaagtctctctttaatgacccgatgtcatgaatgaagcatgaaggacaagtgactaaacacatatcattcttatttaataccatattgaggactaaggctcacattatcctctacaggtactgcttggatcctgtattagtttcttttgctgctgtaacaaattaccacaaatttagtggcttaaaacaatacaaatgcattctctttcagctctggaggccagaaataaaaagtcagtttcactgggctaaagtcaaggtgccacaagggctgcctcctctagaggatctgggaataatctgtttcttgactcttccagctactagtggctatgctatgggtattcctcattggctctggctcatggccccttcctcccatcttcaaagccaacagtttagtatcttctatcattgcatttccttattctttctgtagtctattccccctctacctccctcttataaggacagttgtgattacatttagggtccacccagataacccagaattatttccatatctcaaaatcctaattcacatcacatctgcaaaggctcttttgctataaaaggtaacattcacagtttccaggaattccaacctggatatttttgggagctattattcagcataccacaggtcctgtctcataaatgttttaattggaagctgttcgtctgtggtaaagagtttattactcatatacaaagccatctaaaatacaataaatgtaaattaattagagattgaaaatcaatagtattttgactcctaaacactttattaattgttctgggaaatttttgagccatttctcttggtaaacataatgtaaaaaaactaaagagcagattttagtgggtcaatattatcttggcaatctcatgaatactgctgtgtgtgtgtgcacgcacacatgcacacataagcacacgcaagcttgtgagggtcaggagattggataaaggtatactaaaagtgaacacttaaagaattctaatgatacctgcatgctgtactcatggaatgattcacactataacaactatgggtgctggaatgtacttcagtaagcatcaggcaattttaattcaaaagactctgagcagattttgaagcagttgctctgacacctgagggtgtaaccatgtttgaaggtgtgtgggatgttgagaggagaaggaactaacttttattaaatggctactatgtttcaggtacagagttacaggttttacaaattttaatgttaattaaggctcacgacaacagatgctgcaggtattaaaagaagataataatacccagagaggattaggtaacttttccaagtttgccagctagcaagtggtatagctagacccacattttttgaaatctaaatatccataatggggttttagcatgttagagcagatataggagaggtcaagagtcaagaaaacacaatggttctttcagaagagctctggggaaaaaaggaatgagacaaggggaacaacattatcacacactgcaccagctgactatagtggtaggtcataatgactgcaaaacagtgtgctgggccccatttagtgatgacatcacaatacataactctaagcaaataatgtttctacttctgattcctatttcactgctttgaccctccatcacttacctgggcacagagtattcatggtatcacttctccccataaaatgggtttgacaaccaagcccaatttcttacttcatcctcagatgtagccttatacctttaaatgaacagagattaattgcatagattttccataatggggctcattcattttccgtattatagtatctactttctaaagctgattttactgagatctaattttccagctcatgccactatagaaatgactgttaaaaacttgatccaacaggaatctgagtcattgctacaatgggaaaacatctgtaccataaagaagacaagattgtcatttcattagaattcctcttgactttaaaccattaatctttgtcaataatgggatattcatttgcagctcactaactggaataaaactgaaagtgataccatcaagatatacataattctttgataaaaccacagctttagggtccatgcctccaaggataattaaagaaatagctgttggtgttctgagtctgcttgagtaacctatagtttatgggataaaagagatagattaagacagggcgaatccaggccaagacttcactgagatctcaagtctatgtattgtgaacatatgttttgtgggggaaatgaattaggtaagacatgtcatgaaacgaaggactgagagtcaatgtggttttttctttataataccttcagtagcaaaaattcctttccttatttataggcatcctttcatactttgcctttatcatagagaagaatatatctctggtcctttttagtcaatatctatgaacagctgaaaatacaatgaaagtaagaattgcttcccaaagttcctgtttgcatttccgtttatttacatatgttcctttagacctatatagacccaaaacaacctgagataaatgccactcataactgtatccctcaggggagcatataattaacaaaagcccatatatttgagcttaactgattaatcattttccctcaactctttccattataattcagtttgctttgtgttaattcctttttttaaataatctctcaactcctcctatcacccaggctgaaaaacccaggaatcaccaaagaccctctccctcaactcctgcagccaaagcccagtccaacagaatctatccaacttccttatttcacttttccagctctgattggatttgtatctataataaatcaaaaagaggtcaactaagaacaaaactaacatcattagaataaaatcaccttataaactggaatgcaaggtgctaatgttattacttttcattctgataaaatcaccttataaactggaatgcaccatgctaatgttattacttttatcttttttttagtttgtactgcacatcacagttttaatttttttaacttttaagttcatggttcatatgcaagtttgttatataggtaaatttgtgtgatgtgggtttattgtacagattattttgtcacccaggtactaagtctagtactcattagttatttttcctgatcctctccacccttccagcctccaccctctgataggtcccagtgtatgttgtttccctctatgacttaaacaaaatgacaaaaaagagcaaacaaccacatttaaaagtgggcaaagaacgtgaacactttcctaaagaagatatacctgtggccaacaagcatatgaaaaaaagctcaatatcaatgatcattagagaaatgcaaatcaaaaccacaatgagataccatctcgcaccaatcagaatggctattattaaaaagtcaaaaaaatagatgctgtcaaggttgcagagaaaagggaacatttatacacagttggtgggaatgtaaaattagttcaaccattgtggaagacagtgtggaaattcctcaaagatctaaagacagaaatacaattcaacccagtaatcccattactgcatatatactgagaggaatataaatcattctgtcataaagacatgcacacatgtgttcattacagcactattcacaaaagcaaagacatggaatcaaactaaatgcccatcaatgatagactggataaagaaaatatgctacctatacaccatggaatactatccagtcataaaaaataatgagatcatgtcctttgcagggacatggctggagctggaggccattatccttagcaaactaatgcaagaacagaaaaccaaacattgcctgttcgcacttacaagtgggagctgaatgatgagaatgcatggacacacagaggggaacaacatattatttttatctttacttgaaaagtatgtcttgatttcctccatataaaattcaagaccttggggatgcagacaaaataggttgtttcatgtggggtttatgataggctgaataatagccctttcaggatggctacatcctaataaccagaacctgtgaatattttaccataaacacacatcacaaatggacctatgaagctacaattaaggttcctgagagtgagagattattatggattatctggatagacccaatgtaatcacaagagtccttaaagaaggaaaaaagggtcagagtcagacaaggtaatgagaagagggcaagggccccaatagtctcaaccccttataacatacattcaaatacaaaataccatctaaatctcatcagcttaaaagtcccaaaccttatcatctaaaggatctatgggtgaggctctggatataatctatcctggagaaaaatacctctccatctgtggatctgtgaagctagaaaataagttatcagatcaaaaagtacaatggtggcacaggcataagataatcaatatagacattctcattgggagaaaatagaaggggaaaaaggggtcactattcccatgacattttgcaatccaactgggaaaattctatcatgtttcaaaacccaggaataatcctctgtggctggagggtccatcctctgggcccgtggctctgccatgacctcagagttatccttcttttcatgaagggtaatgtgtctaaacctgagttattttattagcctgttttctaactggagaattttggaagtcaaacaaacttctatcattttgttctttctctgtctctttcagtccaagctggcagtgtttctgctgatacaacattctcaaaaactttgtgggtctcccacacatgttacagggagtaaatccatcaaacaagaggctcttccacaaatatatgcaggataatcccatttttattcctggctcctattgagatctgtgaggggatccatgagtcatatacttaatcttttcaaacacttttctgtgtgattaaaatactgaccttatctaaaatcgttccaaggcacaagcaaaagactgctcagccaaacctttggcattctctccagagcatactttcttgtaatcaaatcttctaactttagcagtttttgaaagctgaatagactgagaatttcctaaattatcaagtcctagttcctttttgtttaacagttcttcccttaatctatgtctttcctctcacattttactataagaaacaagaaaccaagccacattttcaacagtttgcttggatttccaagcaaatttcctcggctaaatctccacgctcatggcttagaaattctatttcccacatgactgcagaacaaaattctgctgagtcttctgccaccaaataacaaagaacccttaattccatctgggccattatgaggagttcctttagtattcctatttctatagtttatttataatagctttaatattctctaagacaatttaatttttctctattatgttcctcacttccttctgagcccttactagcagagtccttagtatctatatttccactagcaatctgttcacagaaatctaggcttttctatcatgctcctcaacattcttccagcctcttcccactggaaatcacaaccacatttttaggtatttgttagcgcataacctcacttccaaatctatgttagcttcctacttctgctccaataaattctcactaacttagtggcttgaaacaatgcacatttatcttctttttctggaggttagaaatctaaaatagattttgaaatgtactgacatttatgagtcttacatgactaaaattaaagtgtcataatcttcattccttatggatactttagggaaggatccattccttgcctttcccagcttcaaaaggccgcccgcattccatggctcatggctacatcacttggatctccgcttctgtcatcacatctctttctctccctctgcttctgtcatggcattgctttttatgacactacccctcatgccttcttctcataagaacccttgtgatttgtctggacccacagaagtaatccaggataatctcaagaacattaacttaatcacctgtgaagccctttttgctatgtagtcatacctcattttattgtgctttgctttattgctctttgcacatattgcctttttacagattgaagttttgtcacaaccctgcatggagcaagcctatcagcaccatttttccaacagcatgtgctcacctcatggcttggtgtcacattttgataattctcacaatatttcaagttttttattattattatattttttgtggtgatttgtgatcagtgacctttgatgttactactgtaatcacttgaggcaccatgatccactatcacatagaatggtgaatttaatcaataaatgttgtatgtgttctgactgctccaccaaccagcctttgccctgtcttgttctttctccttgggcctcctagttcctgagacacaataatattgaaattagactgataaataaccctataatggcttctactgttccagtgaaaagaagagtcatacatctcattttaaatcaaaaactacaggcccagtgcagtggttctacctgtaatcccagcactttgggaagccaaggcagacagatcacttgagctcaggagttcgagaccagcctggccaacatagtgaaatcccatctctattaaaaatacaaaaaaaaaaaaaaattagctgggcatggtggcaggttcctgtaatcccagctactcgggaggctaaggcaggagaatagcttgaacctgggaggcgggggttgcaataagcagagattgcaccactgaacttcagactaggcaacagagcaagagtccatctaaaaataaaaaataataaataaataaataaaaagctacaaatgattaagcttggtgtcaggcctcgagcccaagctaagccatcatatcccctgtaacctgcacgtacacatccagatggccagttcctgccttaactgatgacattccaccataaaagaagtgaaaatggcctgttcctgccttaactgatgacattgtcttgtgaaattccttctcctggctcatcctgactcaaaagctcccctactgagcaccttgtgacccccaactcctgcccaccagagaacaattcccctttgactgtaattttcctttacctacccaaatcttataaaacggccccacccctatctcccttcgctgactcttttcggactcagcccgcctgcacccaggtgattaaaagctttattgctcacacaaagccagtttggtggtctcttcacacggatgcgcatgaaatttggtgccgtgactcggatcaggggacccttggagatcccttgggagatcaatcccctgtcctcctgctctttgctccgtgaaaaagatccacctatgacctcgggtcctcagacccatcagcccaaggaacatctcaccaattttaaatcgggtaagcagcctcttcttactctcttctccaacctctctcactatccctcaaccactttctcttttcaatcttggcaccacccttcaatctctcccttctcttaatttcaattgctttcattttctggtagaaacaaagaagacacattttatccgtggacccaaaactcaggcatcagtcacagacttgggaagccagccttcccttcatgtttaatcattgcagggacgcctctccatttacccacgtttcagaggtgtctgaccacgcagggatgcctgcctcggtccttcacccttagcagcaagtcccgcttttctgggggaggggcaaaaaccacaaccccttctctccctgtctctaccccttctctgcttttctggggtgcaagaaccccccgatcccttatttccgtgccccgacctcttatctctgtgccccgatcccttatttccatgccctgacctcttatctctgcaccccaattccttatttccatgccctgacctcttatctctgcgccccgatcccttatttccacaccccgacctcttatctctgcaccccaaccccttattttggcgccccgacacctttcccacttttctggagggtaagaacctccgaacctcttccctccatgtccctactctctcttttctctgggcttgcctccttcactatgggcaaccttccaccctccattactccttcttctcccttagcctgtgttctcaagaacttaaaacctcttcaactcacacctgacctaaaacctaaatgccttattttcttctgcaatgccgcttgaccccaatacaaactcaacagtgattccaaatagccagaaaatggcactttcaatttttccatcctacgagatctaaataattcttgtcgtaaaatgggcaaacggtctgaggtgcctgacatccaggcattctttcacacatcagtcccttcctagtctctgttcccaatgcaaatcgtcccaaatcttccttctttccctcccgcctgtcccctcagtcccaaccccaagcgtcgctgagtctttctaatcttccttttctacagacccatctgacctctcccctcctcgccaggccgagctaggtcccaattcttcctcagcctctgcttctccaccctataatccttttatcacctcccttcctcacacctggtccagcttacagtttcattccgtgactagccctcacccacctgcccagcaatttactcttaaaaaggtggctggagctaaaggcatagtcaaagttaatgctcctttttctttatcccaaatcagatagcatttaggctctttttcatcaaatataaaaactcagcccagttcatggctcgtttggcagcaaccctgagatgctttacagccctggaccctaaaaggtcaaaaggctgtcttattctcaatatacatcttattacccaatctgctcccaacattaaataaaactccaaaaattaaattccggccctcaaaccccacaacaggacttaattaacctctccttcaaggtgtacaataatagggtagaggcagccaagtagcaacatatttctgagttacaattccttgcctccactgtgagacaaaccccagccacatctccagcatacaagaacttccaaacgcctaaaccgcagtggccaggtgttcctccaggcccgcctcccccaggagcttgctacaagtgccagaaatctggccaccaggccaaggaatgcccacagcccgggattcctcctaagccgcgtcccatctgtgtgggaccccactgaaaattggactgttcaactcacctggcagccactcccagagcccctggaactctggcccaaggctctctgactgactccttcccagatcttctcggcttagtggctgaagactgacactgcccgatcgccttggaagccccctagaccatcacggacgccgagctttaagtaactctcacagtggaaggtaagtccgtccccttcttaatcaatacggaggctacccactccacattaccttcttttcaaggcctgtttcccttgcctccaaactgttgtgggtagtgacggccaggcttctaaacctcttaaaactccccaactctggtgccaacttagacaatactcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctgacctcgtgatccgcccgcctctgcttcccaaagtgctgggattacaggcgtgagccaccgcgcccagccgacaatactcttttaagcactcctttttagttatccccacctgcccagttcccttattaggccgagacatttaactaaattatctgcttccctgactattcctggactacagctgtatctcattgccacccttcttcccaatccaaagcctcctttgcgtcctcctcttgtatccccccaccttaacccacaagtataagatacctctactccctccttggcgactgatcatgcacccctcaccatctcactaaaacctaatcactcttaccccgctcaatgccgatatcccatcccacagcatgctttaaaaggattaaagcctgttatcactggcctgttacagcatgggcttttaaagcctataaactctccttacaattcccctattttacctgtcctagaaccagacaagccttacaagttagttcaggatctgcgccttatcaaccaaattgttttgcctatccaccccatggtgccaaacccatatactctcctatcttcaatacctccctcaacaacccattattctgttctggatctcaaacatgctttctttactatgcctttgcacccttcatcccagcctttcttcgctttcacttagactgaccctgacacccatcaggctcagcaaattacctgggctgtactgccacaaggcttcacagacagcccccattacttcagtcaagaccaagtttcatcctcatctgttaccaatcttggcataattcttataaaaacacacacgtgctctccctgctgattgtgtccgactaatctcccaaacctcaatcccttacaaaacaacaactcctttccttcctaggcatggttagtgcagtcagaattcttacagaagagccaggactgcaccctgtagcctttctgtccaaacaacttgaccttactgttttagcctagccctcatgtctgcgtgcagcggctgccgctgctttaatacttttagaggcccttaaaatcacaaactatgctcaactcactctctacagttctcataacttctaaaatctattttcttcctcacacctgacacatatactttctgtttcccggctccttcagctgtactcactctttgttgagtctcccacaattaccattgttcctggcccagacttcaatccagcctcccacattattcctgataccacacctgacccccatgactgtatctctctgatccacctgacattcactccattttcccatattctttcatgttcctcaccctgaacacacttggtttattgacggcagttccaccaggcctaatcgccactcaccagcaaaggcaggctatgctatagtatcttccacatctattattgaggctactgctctgcccccctccactacctctcagcaagccgaactcattgccttaagccctcactcttgcaaaagcactaaaagtcaatatttatactgactctaaatatgccttccatattctgcaccaccatgcgagaggtttcctcactacacaagggtcctctatcattaatgcctctttaataaaaacgcttctcaaagctgctttacttccaaaggaagctagagtcattcactgcaaaggccatcaaagggcatcagatcccatcgctcaggacaatgctcatactgataagatagctaaaaaagcagctagcattccaacttatacccctcactttcagtttttctccttctcatctggccactcccacctactcccccgctgaaacttccacttatcaatctcttcccacacaaggcaaatggttcttagaccaaggaacatatctccttccagcctcacaggcccattctattctgtcgtcatttcataacctcttccatgtaggttacaagccactagcccatctcttagaacctctcatttcctttccatcatagaaatctatcctcaaggaaagcacttctcagtgttctatctgctattctactacccttcagggattgttcaggcctcctccctttcccatacatcaagctcggggatttgcccctgcccaggactggcaaattgactttactcacatgccccgagtcagaaaactaaaatatctcttagtctgtgtagacactttcactggatgggtagaggcctttcctacggggtctaagaaggccaccgcagtcatttctttccttctgtcagacataattcctcagtttagccttcccacctctatacagtccaatagcagaccagcctttattagtcaaatcagccaagcagtttttcaggctcttggtattcagttaaacctttatttcccttacagtcctcagtcttcaggaaaggtagaacggactaatggtcttttaaaaacacacctcaccaatctcagccaccaacttaaaaaggactggacaatacttttacctctttcttttctcagaattcaggcctatcctcggaatgctgcaaggtacagcccattggagctcctgtatggacgctcctttttattaggccccagtctcattccagacaccagaccaacttggactgtgccccaaaaaacttgtcacccctactatcttctgtctagtcatactcctattcaccgttctcaactactcatacatgccctgctcttgtttacactgccggtttacactgtttctccaagtcatcacagccaatatctcctggtgctatcccaaactgccactcttaactcttaaagtaaataaataatctttgctggcagggctatgctgaacctccttaggcactctctaattagatgtcctgggtcctcccaattcttagacctttaatacctgcttttctctttctcttattccgttcagtttttcaattcatacaaaactatatccaggccatcaccaataattctaaatgacaaatgtttcttctaacaaccccacaatatcaccccttaccacaaaatcttccttcagcttaatatctcccactctaggttcccacgccgcccctaatcccactcgaagcagccctgagaaacatcgcccgttatctctccataccaccccccaaaattttcgtcgtcccaacactttatcactatttcattttatttttcttaatataagaagacaggaacgtcaggcctctgagcccaagctaagccatcatatcccctgtgacctgcacatacacatccagatggccggttcctgccttaactgatgacattctaccacaaaagaagtgaaaatggcctgttcctgccttaactgatgacattgtcttgtgaaattccttctcctggctcatcctgcctcaaaagctcccctactgagcaccttgtgacctcccactcctgcctgccagagaacaacccccctttgactgtaattttcctttacctatccaaatcttataaaacggccccacccctatctcccttcgctgactctcttttcggactcagcctgcctgcacccaggtgattaaaagctttattgctcacacaaagcctgtttggtggtctcttcacactgatgcgcatgaaacttggtgaagtatgtatgtcaaaagctgagataggctaaaacctaggcctcatgtgccaaacagttagtaaatgcattatgtaagaaatacatttcaagttgtgaatgcaaaggaaaagttcttgaaggaaattaaaagtgcgactccagtggacacataaatgataagaaagggaaacagcctgaatgctgatatggcaaaagttttagtgctctggaaagatcaaaccagccacaacatttacttaagccaaatgctaatccagaacaaggccctaactctcttcaattctatgaaggctgagagaggcaaagaaactgcagaagaaaattttgaagctagcaggggttcatgaggtttaaggaaagaagccatttccatgacacaaaagtgcaagaagcagcaagtgctgatggagaagctgtagcaagttatccagaagatccagctaaattgataaaggtgactacactaaacaacagattctcaatgtagatgaaacagccttctattggaagaagattccatttaggactctcataaccagagaggagaagtcaacgtctggcttcaaagcttcaaagaacaggctcactgttttgttaggttgtaatgcagctggtaactttaagttgaagccaatgctcatttgccattctgaaaacactaaagcttttaagaacgatgttaaatgtactctgcctgtgctctataataaaataataaagcctggatgacagtacatttgtttacagcacagtttactgaccattttaagcccactgttgagacctactgcttaaaaaaagattcctttcaaattattattgctcatcgacaatgcacctaattacccaagagctctgactggaggtgtacaaggagactaatgttttcatggttggtaacacaacatccattctgcagccaatggatcaagcagtaattttgactttcaagtcttatgtaagaaatacagggtgggaccaagatggccaactagccaacaagaagcagccaccgtcagaggctcccatcaaaaagaaccataatagcatgtgaatcctgcactggcaactgaggtatccaggttctctcatcagaactgactaggcagctggtgtgacctacagagagaaaggaagcgcagtggtgcagggggcccacctgagagccacacagggcaggtgggtccccacccccccgccaagggaggtgatgagtgagtgtgccatccagcctgggaaaccatgctttttccacagactgtgcaacctcctgatcagaagatctcactcatgaaatcacaacaccagggcctaggatcccaaccacagagccctgcagattctcaaaagcctctcagctagactctgcttaagcctgctgagttcccggtggggaggggcgactagcaccacagttgcggctgcctgttgtttaagccatttgagctctttgggggaggggcagcagccagcactgggactgatagctgcctaacacactaagctccctgggcaggggaagggtggcagccatctctatagctccaggctacacttttcccctgctggagccaggaaggcttggttccgagaggggtcccccgcagcacaacacaccggctgtggcagactgtggccagagtgcctcttcaggcctgacactgacccatccctcctcactgggaggggcctccctgcaggaactccaactccaggcaggggctcaggcacaaagctctgatctccctggccggagccactaggggtaggggtgaccacagtctctgaggaccagcagacttagcctttcctcctgctagttctgagaaatctgggcagcccagatgagtgggtttcccctcagcaaagcactccccctccaccaagggatagtcaaagagcttcattaaacgggtcctgctccctgtaccacccaactaggtgagaccatcaaacaggggttgtcagacatcctatacaggagtgatcatactggcatcagatcggtgctcctcgaggtcagagttcccagaggaaggaggaagcacccatctttgctgttttccagcctccttgagtgactggctccaggcacaggagcgagccagatgaatagtgcctgaagtgaatgcccagcaaaccacaacagccctacagaagaggggcctgaccattgaaagaaaaacaaacagaaagcaacaacaacagcatcagcaaaaagtgtctccccaaaaaaacccatcaaggataggcagcctcaaatatcaaaactagacaaattcatgaagatgagaaaggatcaacaaaaaaaaaaacactgaaagcccaaaaggccagagtgcctcttctcctccaaatgattgcaatgccgctccagcaagggtgcagaactgggcagaggatgagatggacaaattgacagaagtaggcttcagaaggtgggtaatatcaaattctgctagctaaaggatcatgttctaacccaatgcaaagaagctaagaaccttgaaaaaaggttacaggagctgctaactagaataaccagtttagagaggaacataaataacctgatggagctgaaaaacacagcggaagaacttcgtgaagcatacagaagtatcaatagccgaatcaaccaagaggaagaaagtatatctgagtttgaagaccaccttgctgaaataaggcatgcagacaagattagaggaaaaagaatgaaaaggaatgaacaaaacctccaagaaatataggattatgtaaaaagaccgaacctacaattgactggagtacctgaaacagacagagaaaattgaaccaagctgcaaaacacacttcaggatgttatctaggagaatgttgccaacctagcaagataggccaacattaaaattcaggaaatacagtgaacaccactaagatactccatgagacaatcaaccccaagacacataatcattagattctccaaggtcgaaaggaaggaaaaaaatgttaagggcagccagagagaaagaccaggtcacccacaaagggaagcccatcagactaacagcagacctctcagcagaaacggtacaagccagaagagagtgagggccaatattcaacagtcttagaaaaattattttcaactcagaatttcatatccagccaaactaagcttcataagcaaagaagaaataaaatcctttccagacaagcaaatactgagggatttcatcaccaccatgcctgccttacaagagcccctgagggaagcactaaatatgaaaaggaacaactggtaccagccattgcaaagacacatcaaaatataaagaccaatgacactatgaagaaactgcatcaactagtgtgcaaaataccaaggtagtatcatgatgacaggatcaaaatcacatataacaatattaaccttaaatgtaaatgggctaaatgccccagttaaaagacacagactggcaaattggataaagagtcaagacccatcagtgtgctgtatttaggagacccaactcatggtcaaagacatacataggctcaaaatgaagagatggaggcaagtttaccaagcaaatgaaaagcaaaaagaaagcaggggttgcaatcctagtctctgacaaaacagactttaaaccaacaaagataaaaaaagacaagggcattacataatggtaaagggatcaattcaacaagaagagctaactatcctaaatatgtatgcacccaatacaggagcacccaaattcataaaacaagttcttagagacctacaaagagacttagactcccacacaataataaaaagggacttctaacaccctactgtcaatattggacacatcaatgagacagaaaattaacaaggatattcaggacttaaactcagctctggatcaagtggacctaaaagagatctacagaaccctccacaccaaatcaacagaatatacattcttctcagtgcatggcatttattctcaaattgaccacaaaattggaagtaaaacacttctcagtaaatgcaaaataactgaaatcataacagcctctcagaccacagtgcaatcaaattagaactcaggattaagaaactcactcaaaaccacacaattacatggaaattgaacaacctgctcctgaaggactcctgggtaaataatgaaattaaggcagaaatcaagttatttgaaaccaataagaacaaagagacaatgtgccagaatctctgggacacagctaaagcagtgttaagagggtagcactaaatccccatatcagaaagctagaaagatctcaaatcgacaccctaacctcacaattaaaagagctagagaagcaagagcaaactaatccaaaagctagcagaagacaagaaataactaagatcagagcagaactgaaggggatagagacacaaaaaaccctcaaaaaaatcaataaatccagcagctggttttttgaaaaaattaacaaaataggtagactgctagctagactaataaagaagaaaaaagaatcaaatagacacaataaaaaacgataaaggggatattaccacttatcccacagaaatacaaactaccatcagagaatactataaacacctctatgcaaataaactagaaaatctagaagaaatggataaattcctggacacatacatcatcccaaaactaaaccaggaagaagtcgaatccataaatagaccaataacaagttctgaaattgaggcagtaattaatagtctaccaaccaagaaaagcccaggaccagaaggaatcacagccaaattctaccagccaaattctacaaagaggagctggtgccattccttctgaatatgatccaaacagtgaaaagcaggtactcttccctaactaattttatgaggccatcatcatcctgataccaaaactgggcagagacacaacaaaaaaaagaaaatttcaggccaatatccctgatgaatattgatgcaaaaatcctcaataaaatactggcaaaccgaatccagcagcacattggaaaacttatccaccacaatcaagttgacttcatccctgggatgcaaggctagttcaacatacacaaatcaatacatgtactccatcacacagacagaaccaatgacaataaccacacgattatctcaatagatgcagaaaaggcctttgataaaattcaacatgtcttcatattaaaaactctcaataaactagatattgatggaacatatctcaaaataatcagagctatttatgacaaacccacagccaatatcatattgaatgggcaaaagctggaagcattccctttgaaaactggtgcaagacaaggatgccctcactcaccactccctttcaacataatattggaaattctggccagggcaatcaggcaagagaaagaagtaaagcatattcgaatagaaagagaggaagtcatattgtccctttttgcagatgacatgattctacatttagaaaacccagcatctcagccccaaaactccttaaactgataagcaactttggcaaagtctcaagatacaaaatcaatgtgcaaaaatcacaagcattcctatacaccaacaatagacaagcagaggaccaaatcacaaatgaactcccattcacaattgctataaagagaataaaatacctaggaatacagctaacaagggatgtgaaggacctcttcaaggagaactacaaaccactgctcaaggaaatcagagaggacacaaacaaatggaaaaacattccatcctcatggataggaaaaatcaatgttgtgaaaatggccattctgcccaaagtaatttatagattcaatgctattcccatcaagctaccattgacaatcttcacagaattagaaaaaactattttaaatttcatatggaaccaaacaagagcccatatagccaggacaatcctaatcaaaaagaacaaagcaggaggcatcacactacctgacttcaaactatactacaaggctacagtaaccaaaacagcatggtactggtaccaaaacagacatatagaccagtggaacagaacggagaactcagaaataacaccacacatctacaaccatctgatctttgacaaacctgacaaaaacaaacaataggaaaagaatttcctattcaataaaaggtgctgggaaaactggctagccatatgcagaaaactgaaactggaccccttccttataccttttacagaaattaactcattaaagacttaaatgtaaaacccaaaaccataaaaaccctagacgaaaacttaggcaataccattcaggacataggcatgggcaaagacttcatgatgaaaacaccaaaagcaattccaacaaaagccaaaattgacaaatgagatctaattaaagagcttctgcacagcaaaagaaactatcatcagagtgaacaggcaacctacagaatgggagaaagtttttgccatctacccatttgacaaaggtctaatatccagaatctacaaggaacttaaacaaatttacaagaaaaaaaaatccccatcaaaaagcgggcaaaggatatgaacagacacttctcaaaagaaaacatttatgtggccaatgaacacatgaaaaaaagctcaacatcactgatcattagagaaatgcaaatcgaaactacagtgagatactgtctcatgccagtcagaatggtaattattaaaaagtcaagaaacaatagatgcttgggaggctgtggagaaataggaacacttttacactgttggtgggaatgtaaattagtccaaccattgtggacgacagtatggcaattcgtcaaggatctagaaccagaaataccatttgacccagcaaccccattactgggtatatatccaaagaattgttccattataaagacacatgcacacatattatcactgcagcactatttacaacagcaaagacatggaaccaacccaaatgcccatcaatgatagactggataaagaaaatgcggtaaatatacacgatggaatactatgcaaccataaaaagaaatgagaccttgtcctttgcagggacttggatgaagctggaagccatcctaactaactaactaacaggaacagaaaactaacacaggaagagaaaaccaaacaccgcatgttttcactcataagtgggagctaaacaatgagaacacatttagcggacaacagcatagtgtaaatacaacttttatatgcacttggcaatcaaaaaattcatgtgagttgctctactgcagtattcgctttattgcagtggtctataactgaatctgtagtacctccaagatatgcctgtgtaaagcaacatattcacagttctgtgtattacaatatgaacatctctgacatgaaaatatgcataaatttctcacattttataagaagtttttattcatctttctatttgaaagacgctttttccgagtataaaattctagatcaacagctaatttttggcaccttaaagacagtccattgtctttctgggtcacaaagctagtggtaagaagtccaccatcaccctcatctttgttcctctgtaagtaatgaagttttggagtaatgaagtagtttgtaagtaatgaagtcttgaagtttgccattttttttcttctggcaatttaaattttatagttgaggttcttagagtgaacttttcatttcagtaattgtacttttgaactccagaatttctatttgatttttttaatcatttctctctattgatattctctatttgatgcaaaattgttgtcctaccttcctttatttaatcatagtttcctttagttctttgaacatatctacaatggctactttctagtcattttctgttagtctgatttctgaccactgtctgcctactgtacttacaaagtatgggtcatattttcttgtttcttttcacgccttgtaaatttctgttggtaactggacattttaggtaatacatcatggcaactctgggtaaacccacccctgctctaagcttgttattatttgttttttgtttaatgactagctggactattttagtgatgttcactgtcatcctcatctttgattctctgtaagtaatgagtatttttccctttttgcatataagtttgtcactgtatcactagatttcagtaaactgaatatgacacaaatatgactattttccacctgcagtgttaaatctttggtgctgctcctcaaggagttgtagctttgtgcatgtatgctcacatatggtcactagtatgacagtggttttggcaggactctttttgtcactttctctgaccacgtccaactgttaagctatactaagtgccagctgatttatgtactgctttcaacaatactgtggtgcttaaattgttctatagactaatccatcaaattcgggttcctttgaaggagtagttcctacattgtttgagatttgctctgttgaggagctctgaccacagatgggctcccacaagctgtctctttccaagggtctctgcttttccctccaggcaaaatctcaagtcaagtcaagttgagtcaaggctctggaactagggtggcagacaattgcacactctctctaaatgacaccctcactttaagagctgagtgctcattgggggccagagagggtagaagatgaacagtagcctccaacttttttggctagtttcatccagagtacaacactcactttacagactaaggcaaggacaatcagaacccctatatctcagcagtgccaaacccaaggtaaagactgcatctcatgagtggggagctgtgcagaagagaactctacttcagaacttagcctcatcaataggtagctgtggcaagatgagaaaagctgatatccttccataggattactctctgtctgggagctgagaatagagagagccttgtgttttgggctgcactagtttggaataaagtttccatctcactaagctgggaaaggggataggagggaaagggtctcagttccccatagagtcttgctgttcttaccacaatacagattttctggaataaacgtttcttcatctacttattatttaaatgtccgtaagactatttccagagacattaaatggtatgttgttgggtatttttgtttttgtttttgttttgtttcttttgtttgtttgcttgtttttgagatagagtttccctctttttgcctaggctggagtgcaatgttgttatctccgctcactgcaacctccacctcccaggctcaagtgattctcctgcctcagcctccctcccaaatagctgggattacaggaatgcaccaccacacctggctaattttgttttatgtttatttgtttgtttttgagaaaatgtctcactctgtcacccagactggagtgcagtggcacgatctcggctcaccgcaacctccgcctcccaggctcaagcgattctcctgcctcagccttccaagtagctgggattagaagcgcacgccaccacacccagataatttttgtatttttagtagagacggggtttcaccacgttggccaggcttgtctcaaactcctgacctcaaatgatccactcgcctctgcctcccaaagcgctgggattataggcgtgaaccaccgtgccgtgtgtgtgtgtgtgtgtgtgtgtgtgtgtgtgtgtgtgtgtgtgttttaattatcttcaccagtttttctggagaaagagtctgctgagcttctcatgctattatgccagaagtccctcccagtcaattaacaaaagtggcaaggtaattcaatgagaatactagagtctttttcaaaaaatggttctagacaatgaatatgggaaaaatgaaactcaacctttccttataccatatgcaaaataatttggaatgaattacagcctaaaatatgagtcaaactattaaacttctagaagaaaacacaggaagaattatttgtaattttgggataggcaaagatatcttagctaagacacaaaaaacatgaatcatacacacataaaaactgtaaaactgggcttcatcaaaaatttttaaagtttgtcctttaaaagatactgtttgaaaaattaaaaggcaagccaaagactacgagaataactttaaaaccagaaatctgatgaagaacttgtttttgagatatataaagaattcgttcaactgaataataatatagacaatccaatttaaaaatgggcaaaagtttgaacagatacttcatcaaagaagatatgaaaaatggcaggtaaataaatgatgttctataatattggtagtctttaaggaaatgcaaattaaaaacataggattgcactatttacctattaaaatggctaaaacttaaaagactgatgatatatatagcaagggtacagagcaactgtaatacttatacattactgattggaacttaatacggtacagccactttggaaagcagtttggcaatttctccaaaagttaaacacagacataacatacagtgcagtaatcccactcttacatgtttacccaagagaaataaaaacacaaagacttacatgcaaagattcataactttattaattacagccaaaatctggaaacaacccaaaagtctatcaacaggcaaatggaaaaacatgttgtagtatagccttacaataaaatactactcagcaacaaaaggaatgaaaatatcagtgaaagaagccaggcacaaaagactgtatgattctatttgtatgaaattctagaaaaaaaaattatagtgatagaaaacaaatgtgtggttgcctcagggtgggactgttgtgtggaaattggccaaaggggcatgagagatctttggaagaatgatgaaaatattttatatctttattatggttttagttacattactatacatttttcaaactcacccaaatgaatcctgaatgaattttattgtatgtaaattatatctctaatttttttaaaaaggtcaatagaagcaatgtattaaatagtttaatagtagagaaagatcagaaagatcaagacagagacactgtcttcatgtatattaacgtactggatatcagagattctgaaattatgttagatatcaagtgaaaatattcttttgtcaatcattttcattcagttataagaccaacatttatcttaagccagatttgtgaaaattcaatgtaaaaataattatcatactatttcacaagagtgttattgttccttgctcattaaaaaaaaaaagagcaagagcttgttgagatgtcatagctaacaaagctataataaactgggatttttttcagcaaatgtttgcttccctttcctctttgggtcagggtatactttccactcccactgcctttatgcttggccatgcgacttgccttggccaatggaatatgagcatgcaggatatctgcagaattttaaatgtgtttgcctggcttagcttgcacttgaactcctataatcaacatacaattacaacataggcaaccagtgcctcgttaggctggatcaaagcgtgaagcttaaggggcaaacctgaacttacctcaaagcctgaaactgaactacagcataaagcagagccacttatgagtgagaaaattaaaagcttgccatgatacgacaataaatttggtggaggtttgttacagcattattatggcaagagttgactcatgcaaagctaacatttgaggagaaattacaatgttctaggcactgagctacaaactttacatatattacccatttaattatcacaatgactctgtaagagaaaacattttacattgtctttctaaaatacatgatgaaactgaagcacaaataggataattgcattatccaaagtctcagagctagtaagtaaccaagtagggtttaaacccaggatgttataattctaatactcacccaatgcactaattatcaagatcaaattgaatttttaaattctattcttctagttggggtgttaaataatggttaacactcttcaatctccataaacccttttcttctcttccacctaacctgcccatcttcatacctgtatctaaacaaccatctgtttactgtaccccaactattgggttgtcagtagctagaaaagtacgctgccttgactccattacaaggttagctgatggactttccatatagctttgcaaaattgtgcttattcatgttgattccattttgcattccccacaatagctgttccaaaccttaatcaccaagataagccctaatttcaatatcactcctcactctcagaggctctgcctccaatttctcagcgaatgaatattccatgaggcattacatttctcaacttttttcctctctgccttatacctatctttacctctctttactccttgctcttgtgtctcaaatgactaattctacccccatattcttgtctttcttccttcccataccttgttctacagatttaacatcttcctttttttctctctactagaaaacctacatactcatttctcccacatctttttttgctcttgttgcccaggctggagtgcaatggcatgatctcagctcactgcaatctccacctcccgggttcaagcaactctcctgcctcagcacccccgagtagctgggattacaggcatgcgccaccacgcatggctaatttttgtatttttagtagaaatggggtttcatcatgttggtcaggctggtctcaaacacctgatctcaggtgatccgcccgcctcagcctcccaaagtgctgggattacaagcatgagccaccatgcccagccctatttctcccacatcttaagccaactttcccacaaacctgatgcctccacaaaccaccaactcatctttctccctgctttcactgttaaacttcttgacaaagtaggtgctgtatcagctatctttactttttcacctccaagtcactccttaatacattacaggataagttccccttctgtgaactttaccaaaattattctctcaaaggacactgacagtttccaaattgcccaagtcagtgatctcctctcagttatcatcttaaccaagcctttctctagttttaaatgacactgttgactacatacatcaactccatccctccagacccaccctgcacctcattgttcctccttctatgttctctattatggttactggtaccattcagtcacccagcctagaagtcttaaggtcaatctagtctttttctctctcacatcatagcctcttaacatctccaatattatttttattactattttgctcttataatctctcagttggactattcaaaaagtcttctaagatggaagttgatagcaataaacacctacatcaagaaacgtagaaagatttcaaataatcagtctaatgatgcacctaaaggaattagaaaagcaagaataagccaaatcccaaagttagcagaaggaaagaagtaataaaaatcagagcagaaataaatgaaatagagaccacaaaaataaaaaagatcaacgaaatgaaaagttggcttttcaaaaagataaaattggtaaaccactagctagactaaccaagaaaaaaagagaagtccaaataaataaaatcagaaattaagaaatggaacatcacaaccaataccttagaaatacaaaatatcatcagagactattattaacagctatacataaacaaactggaaaacccagaggaagtggataaattcctggacatatacagcctaccaagaataaatcaggaagatacagaaaacctgaacagaccaataataagtaatgaaactgaatctgtaataaaaagcctcccaacaaggaaaggcttggaccagatggcttcactgccaaattctaccaaacatataaagaagaactagtactaattctcctcaaactattccaaaaaaataaagaggagggagttctccctaactcattctatgaggctagaattaccctgatactaaagccagacaaggacatataccaaaaaaaaaaaaaaaaagaatatccctgaaggacatagacacaagaatcttcaacaaaatactagcaaactgaatatcatagcacatcaaaaagataacacatacaccatgatctagttgcatttatcccaggttgcaaggatgtttcaacatatgcatatgaataaacataatatatcacatcaacagaatgaaggacaaaaatgatatgatcattgatagatacagaaaaagcatttgataaaattcaacaatgcttcatgataaaaattctcaacaagctagcatagaaggtagatatctcagcataataaaggccatatatgataaacccacagctaacatcatactgatggggaaagcatttcctctaagaactagaacaagacaaagatttccactttcaacactctatgcaacatagtactggaagtcctagccagagcaatcgggcaagagaatgaaagaaaaggcgtccaaactggaaaagaagtaaaattgtccctctttgcagacaatttgatcttatatttagaaaaatcaaaagaaaccaccacaaaaaaaaactcttcaaactgataaattcagtaaagttgcaggacgcaaaatcagcacacaaaaatcaccagtatttttatacaccaaaaatgacatagctgaaaaagaaaccaagaaggcaatcttatttacagtagctacaaaccaaataactaaaaataaatttaaccaaggaggtgaaagacatctagaaggaaaactacaaaacactgataaaagaaactgaagagggcataaacaaagagaaagacatcccatgttcacagatcagaggaattttatggcaaagaattcaaaagcacagacaacaaaaacaaaaatagacaaatggaattacattaaactaaaaagcttctgcacagcaaaggaaacaatcaacagagtggagagacaacctattgaatgaaagaaagtatttgcaaactattcatccaacaagggactaatatccagcatataaggaactcaaatgattcaacaataaaaaatctaataatcccattaaaaataggcaaaggaaatgaatagacacttctcacaagaagacatacaaatggccaccagggatatggaaaatgtcaacatcactaatcatcagggaaatgtatattaaaaccacaatgagatatcatcttaccccagttagaatgactattattaaaaagacaacagatgctggtgagaatgcagagaaagggaacttttatatgctgttgataaaaatgtaaattagtacagctgctatggaaaacagtatggagatttttcaaaaaactaaaaatagaactaccatgagattcagcaatcacactgctggttatttatcatcaaaggaaggaaaatcagtatatcaaagggatacctgcaccttcgtgtttattacagcactattcacaacagcaaagacatggaatcaacttaagtgcccatcaacggatgaatggataaagaaaatgtggtatatatacacagtgaaatacttgttgtccataaacaatgagatcctgtcatttgcagtaacatggatggaactagaaatccttatgttaagtgaaataagctagacatacaaagacaaacataatatcacattttctcactcatatgtaggaggtaggaaatgcaaacttaatcaagtaatggctttcctctccttcccacttcttttccccatgcttaaaacccttcagtgggtattccataattatccattgcctagaggataaggacaaaatgtattattgggaataaaaggtgttttttggccacctctacagcatcaactcctgatcacctccccataccatgtcttttgcatccttgaaatttttccaccttgttcccttcaacatcactttttcctatttcccccctacctgtataatacctttcagtttctttctcaagttcttagatcctcgggtctttgttttttcttctcttttagttctagcaattcaattgccctgggcaatcttgtcccttctgatcaacctcattgtgtccaattaccaactattcatcaatagtttattaattttaatctacagcctccaacttctatcctaagccatagtcccatagacattctagtattgtcaataattacagctcatttattgaaaaactgctacatgccagcaattgcattagatgtgtgctagaacacatatctattaaataaacatgttctcatttaatcattacagaatgctgtaaagcaggcacaactgttccttctttgggatgaacacagacatggaatttatataatgttcccagtatcatataggtagaaagtactgaagcaggaatttaagctcagattggcaaaagaccatttcactaagatattcactactttttaccaaactccttcaaatgcacatattcttcagtacttattttattatttccaaacccaaatcactcctccatctgttattcccacattcactcatagcattactattaccaggaacaatacagaagtcttccaagtcacatttaactcctccatctaacttctccatatttgttgggtcactaagccacattctatgtctgaaaaagctcttgaatctccctctttttattgtagtatttcagtagctgtctcacagttctccagtttctgcccctgtaattatcttccatttctttgagagtttgctttctaaataaatctgactgacttctagataagatgactgaatatgcacaattctcttctctacttcctaatattccaattaaaatgatcagtgaaaccattaaaaactagagtaaccagtactacaaagaataacattctcacatcacagaattgaagaacttttgtaagtttaggccaacagaactttattgaaggaaggattggcccaaaccaagactcactagttaagaagtaacttgtctggaaagtaaataaagaaaaccaacagaatcccacaaatatgctcacatttggagatgtgaggctggaggtgaaagcagactgtgaagcaagtaggtgattccatattatattgtggcttagagttcaggtggacatttgataccaactcactgtgtcctttaagctgtaagggcatatactaatactaagtactctgtggaatattaagtcctctagtggaaggccatcttccactagacttaggcaaaggttaggaattacttccctcactccattcagggagggtattcacatacactatcatctttctccaaaatctctcccctaatctcccatctcctaactttcacaacctccatgtctttaagggatgcaaatgctgtctgactaattctaccctaactttataaattctaaaccactgtggccttcaaccccactttgaagtatggcatctagtatcttggggcttcaaaagaaacttccattttaatatccttttacattaatactctggataatgtttctatctgtgatttgatggggagggttttttttggggggggcggggccaaaaaaaaagtactcaaagctaaaaaaaaactccatccaagatcctttgtctttaaataccatttgaagttagactagtggattcaaatcctgactccagggactaactgtataagctttgggaacaatctaagcatcttaagtttcagttttataatcatatatgaataatgacaggccttcgtagaattttgtaaaaattaaataacatgttctaaacaaaactaaaaatatttctagcggcccataatgtcccagatgaaaactgccccttccacgtctctttgaccatgtcatctccatgtcatctctatgtcatctccgcctcactcatgccaatcactgttccacctcaagcgttctgctgccacttcttttttctccccctggaatattcattcctcagatagttgatggctaactgttccacctgcttcaggtctttgctcaaacacaaccttctccatccttctctgagcattccatgtaagcctaagccccttgttttacttctgcccttccctctatcccttccctgccttgatttgctccatagcacttatcatctttatcatactacatattttcacatttttactttaccttctgtctcctcccacttaatgtgggatccactaagaacattacctggcacataagaactagtcggtagccaggaacagtggctcacacctgcaatccagcacttttggagacagaggcaagagaatcacttgagcccaagtgttcaagaccagcctgggtaacacagtgagaccccatctctacgaaaaaagaaattaattagctggccatggtggcacacacttacaattccagctacttgggaagctgagggggaggatcacttgagcccaggaagttgaaactagagtgatccatgatcacacaactgtactccagcctggttaacagagggagaccgtgtctcaaaaacaaaaacaaaaacaaaaaacaaaaaacaaaaaaactagtcaataaatacaggctactgttgtaataataaatattataatgcagcacctctgtgaaatattccaggaatcagacctgactgcagcattgttcctggcttacacacagcatgtcaggcaaaagtgtatgtcagacaagaaaaaggatctgctcatatgaaagcatagggtaaaatcacaaggatcaatgagggtaagttaaatagtatcccataacatcaagttaaattaaaaattaggagaaatggggccagcaagatggccaaataggaacagctccagtctgcagctcccagtgagatcaatgcagaaggcgggtgatttctgcatttccaacccaggtacctggcttatctcactggaaatggttagacagagggtgcagcccatggagggcaagctgaagctgggtggggcatcccctcacccgggaagtgcaaggggttgggaaattccttcccctagccaagagaagccgtgagggactatgccatgaggaacagtgcactccggcccagatactacacttttcccactgtttttacaacccacagaccaggagattccctctagtgcctatgccaccagggccctgggtttcaagcacaaaagtaggtggcaatttgggcagacacctaactaggtcaggagatcgagaccaatctggcaaaatggtgaaatgccatttctactgaaaatacaaaaattagctgggtgtggtggcgcgtacatgtaatcccagctactcgggaggctgaggcaggagaatcacttgaaccaggcagtctgaggttgcagtgagccaagatcacaccacagcactccagcctggcaacagagctaggctccgtcaaacacacacacacacacacacacacacacacacacacacatcaggaaacaacagatgctggagaggatatggagaaataggaaagctttacactgttgatgggagttcgaccattgtggaagacagtgtggcaattcctcaaggatctagaactagaaataccatttgacccagcaatcccattactgggtatatacccaaaggattataaatcatgctactataaagacacattcacatgtatgtttactgcagcattattcacaatagcaaagacttggaaccaacccaaatgcccatcaatgataggctggataaagaaaatgtggcacatatataccatggaatactatgcggccataaaaaaggatgagttcatgtcctttgcagcgacatggatgaagctggaaaccatcattctcagcaaactaacacaggaacagaaaaccaaacaccgcatgttctcactcataagtggaagttgaacaatgagaacatatggacacagggaggggaacatcacacactggggcctgtcgaggtggggggcaaggggagggatagcattaggagaaatacctaatgtagatgagagattgatgggtgcagcaaactaccatgacacaggtatacccatgtaacaaacctgcacattctgcacgtttcccagaacttaaagtataatgaaaataaataaataaataaagctaaatttaaaaaaaagaataagatcatgtcctttgcagggatatggatggacctagaggccattatccttagcaaagtaacacaggaagagaaaaccaaataccatatgttctcacttataagtgggaactaagtgatgagaacacatggacacatacagcggaacaatacacactggagcctattggagggtggaaggtggtaggaaggagaggatcaggaaaaaaaaaactaatgggtactaagcttaatacctcggtgataaaataatatgtacaaacccccatgacataagtttagctatgtaacaaacctgcacatgtacccctgaacttaaaagaaaaaaaaaaacagtggaggcaattgcaaagacaataaatgatgtatttgattacattaaaaattgaaatatcaaaacattcccagaaaaattaaaaagaaagaaaaccaaagcagagtattcacacacaaaaaatataattttttaaaaaatctagattttataatttgacttaagaaacaacataacaaagactggtatggaagatgcaaaatttttaaatctaagtatgtcactgtttattaaagtagtaaaaataagagtaagtgaaatatacattaaaatgcacactagaatttggctgggtgcagtgaatcacgcctgtaatcccagcactttgggaggccaaggcaggcagatcatgaggtcaggagttcgagaccagcctgaccaacacggtgaaaccccgtctctactaaaaatacaaaaaaaaaattagccaggcgtggtggtgcacaactgtaatcccagctactcaggaggctgaggcaggagaatctcttgaacccgggaggcagaggttgcagtgagccaagatcgcaccactgccatccagcctgggtgacagagggagactctgtctcaaaaaaaaaaaaaaaaaaaatgcacactagaatttaagtttttattctctggttgcttttatttcaattactaatgttagaagctattttttagcaaatcctcacaactttgtacttttccaggcaatggccatcaatatcttcctttctctaaactggccaagaaatcttgataacaaattattttgacctcatgatattatatcagctacctctaagtgctttctctagtttatagcctagcaggcagaaactctgccttaattattcacatagtatctgatttaagtaacctattatatgcatatacttaattataataaattgtatcagggtctctcaacaaaatgaacttctattattgtaagcctacagatatagggaaagacttttgtctcaagcacgacaaaatctagaggttcacctaaaatagagattaaagaaaaagacctttcagttcctatggctattgtttcattaattttagcatacatgtaatttaccaataatctaatgtagtctattttttaaatgatttttaagtataactttgtctccattatgaatatatttttacaagttacttctaaaactaagtctatttctaaaaccacattttggaatggcaagtcatcttttctctcagaatgaaatctacaacataacgttaatcttttaaggatagagaggaagagaggattaataaagcaaatcttattccagtacaaataggaatctgtatgtggctggagaggtacctttatgctgaataattttcaagttatatgtaactttattctgcggttttctattcctgtgggactgtgagagcaggtgaaatatttgtcaccaaccataaaaaattatgaactaaagtaataacactacaataactaagctcgtctctaacagatgtattctgtggaaatttcccaagacaacagccttagaaaatggagtagtgttaatttcaactaaagttctccatattgaactatgtcttacaggtctaaagttctgatgcatctttaaataatgggttttgaaaaaagcttcatacatcttgataactttctcggctttaattgtgttgattctaacaatcctaatgagaaaaattaatgcctaaagccaatggtgataccagaaagatattaaaatacagctggcactctttatccatgggttccacgtctgcagacaagaagggtcaactaaggaacttgagcatccatggatttcagtatcctttgggttcctgcaaccaaccccctgcagatactgaaagatgactatatctggaacatacagattaaatgagatattgggaataacaaaagagggagaaatgaaggggaaaggtttcaagtgaattaattcttacttaaaaaattcatactaatagattaatttctcctttttgagagtcaatcacatgataagtcaatgtaatatttttcaatatacactaaatagtatagaatttggtgaggcacaaattccctgaactggatcaacagaagtttcttatttaaagtacaagaccatcattaaaagtttcacttacaactgtaaaccccaagaaagaacagatgctctgaagcattcttcacactgtccttaagtccctatgtccacctcttcctctgcattcagattaacttctgaaggaaatcctgaaatcaagcaaatataacactacagctacaggcattctttttttactctgcttagttcctctttcttcagtactaaaattaaagctatacaactgccttagcagcctgaataaatgttctatctttgaaggattagaaacctgcaaatggaaaaggcgttacaaacaaaacagtaacttaaaaagatacttcaggccaggtgcggtggctcatgcctgtaatcccagcactttgggaggctgaggcaggcagatcacctgaggtcagaagtttgagactagcctgactaacatggtgaaaccctgtctctattaaaaatacaaaaattagctgggcgtggtggcacatgcctgtaatcccagctactcaggaggctgaggcaggagaattgcttgaacccgggagatggaggttgcagtgagccaagattgcgccactgcactccagcctaggtgacagagtgagactctgtctcaaaaaaaaaaaaaaaaaaaaaaaaaatcagtagtatctttaggagcccaagaagccatcctaacgaaaaaaacacaaatgcttattaaggggatcctgatgaaaagactcaggatgttcaaagtcttaaatttgttttaaaaaccttcaaagtataaatagctattctaatatctaattcaataaacaaagagaataaggaaacataacataactgatcactgtaattgtgcataagtgcacatgcataaagaaccaatgattaaagacagaagtaacagtgatgttaagaaacattgatgttgcaacataacaaactaatgagaagcataagaacagtaaacattgggcaaatttgtctcaagctcatcttcatcagatttcagcttacagtatcctatctactcggaagtccttaatagtatataaaaatatctctaagcacttcaaaaaacaacattaagaagagcaaaatatggtggttttattcatgtggcttctcatttattgaaaattcagggtctccatgcttgcaatttgcaaacaactacaaacagcagcctcaattttctatcttatcacttgggaaaaagcactaaaatcatttttaatggtttattttgtaagcacaaattgtaagcatcagattgtgaaagtatcttgatgctataaacaaacagtaaaattacaatttacaatttaattaagaaaacaaaaaatataacctgtcattttattatttttaaaaatctaattgatttaaattaaatgccatgtttcatttgtcatataagaaaatataaattcacctttcatattaataattatacttcaattatattttatgatacaatatttaactactgatctaaaatatatattttcttatttttaaaatacattccataaataaaagacaatgattttctaaatatttaatggtgttcaaaaaaacagaaagaaccacattaataggagttcatgagccatatacggttggaaaaatatgctcttagataagcctgattattcccactctaccagtaataacaaaaagactcagttatgtaagtaatttgtgtccaagtttacataactggtgagcagcaacactagggtttaaaccagggccgtgtaactctcagcttattctatgaaatcatgatatcaatgaacaaatgaatgaattttatttccccaaggtttctgaataagaagctatttccacacactgttaggtggcttcattgtgccatcaataataacacagatacaattaaggaaataattcagtgtaacaaatattttctctagtccctatccaagtgtttagtactcaaaaatgaaatgctcatgtattagcaatctggctatcaaccaattcaaattaaaattccatttaccaatgtcatcaattacttcctaatgtcaactcttttgcagttttcattgcttgtggcctcagcagtcagtcattttccctcaaatattctcatttagttcctgttatgttacattaccctgaattttttctacctcttcattcccttgcttctatacaatcattgtaatgacataagtacaaatattaacaaaagtatatcagtgcaacaaaaaatatgacagagtaagtaacattaactaggacagagagaggtataaacttctagatcccaaaattctcactaagggatggatggctgtaaatgactgtattggaaagtcacatcagttcagacctcaggaggcagtattgtcccatctgggcatagtcttacatacagaagcaatccagcctgcatctgagacaggtgtatttttttctaacttcaagttgtataacatgtaacatgactgcaagagtactatacataacacattcaagcagttttttaaatccttaatcctcaccctcagactctctctagtctgataaagcctagtccctataaattactaaattcagtgtcatggaactggaactacaaatccctgggagtcatgctatataatctattctaatttctttcatataccccatattccctatattcttcacactcccaaaaatgggacccttcaaaggctcaggtctgaacccctttctcctccttcaatatatcaagcttatacctttgtgtttataattccacaatcaaatctcttgccctaaaagctttcccaagctcctttttcaaacctccccctgctaggcatcaccaccttggaattttgcagtcacctcaaggttaacatgtttgaaactaaacttatcctctttctaacacagccagtttcccttcttgttttctgagttgcagaagagagtgatccctggtttcctctcttctccctctctcctgcaacctatagccaccaagtcttgtaaattcagccttcataagtttccttcctgaccaccccaatcctcatctcagccctttttcccagagaaatgcaactgtttcctaactgatttctacacaaactgtctcttcctctccctctgctcaaactatatttcacacttcacttcctgttaaaaaatctttaatggatccccattgcctataaaatatctttcatactatttatccaattatttaaaattcttgttggatccctgtctctataacctcttctctctcttctcctatacatcagtcatccaatccagtcaaattgctccaaataaaacatgcagtcccacttacgtgatgttggttggaaatttctcacgcctagaatgctctcctttctctcctacacttaactaagccctacctttcaaaattggattgctatctcaaatctctcttattaaacacatgtgaaaaatgaaccattttctcataatccttgccaaaaaacaacatctaaactcctaaagaatccatccaaaagaaacacatgagtacacctaaaatctgaaagtcaggagaagaagaataatgtatgaatgcaaatttctttttccttctatattgaagcacttttggcctcatgtgttcactttctattcttaaaggtagagacttaattctattttctacagctcttaaaggctgataatgcagttattatgattgcgactagctagctcatcttgttagagaaagtatcatggtactgggttaagtttaaatatccatatggaatagaaaacttcatttatttgggtgccacaaattgcaaccctgacccttcccagaagtctattaatatctaccatgaacaccaagataatgtttgtggccagatgaaagtaaaaacagcctaaagtgaacacccaactgattttatttccttaaaatggatttgaaatagaatattttattattagttactttgaatattattgatatttacaaaaacatacttcaagtaaatctgcctaaaattggcttgagaactatctgaagagatttttttttttagattttcagaaaaatattcctcatggaatatctttccaattttgcagcataaaaaaatagaaaacattattttgtttcttatcaaactaatttttcaattttcattcatttaacaaataatactgagtatatacttatgccagaatttttctagacaccagtaatacagcaataaactaagtagataaagctgctgctctcaagtttacattctagtggaaggagatagaaaataaacaagcaaatatataatacgttgaatcgtggtaagttctctgaagaaagataaaacagggtaatggaaatagagaacactaagaaggaaaacagagaagactttattgacaaggtgatatctggacagatattttaaggattatagctattcataaaatatggaataccagcatagccaaaattcaggtaatactgtgatgtagtaacctaatgtttcctagttacattacttaaatattctgtcctactgaattaacaaatcctgggagtaaaatatttgtaaaagcctaggctgcaaccaccctcaatcatctgatatagacactatagttttctaagctccctccatcagcaaaatattcgttactcaaagctgatttgtactgaccctgtgggacacaagcccatttcaaggctgctggctatagcttgaaaagaaccactgagatgtaactgaacatttctgttcaagtagggctggccctacccctacctcctataagctttgacctggatacataatccggggctaattaatcaatacatccatctctttgacaactgagattggctcagcagtcaaaatgtgatcaaacttagaaatcttgcttgaatttggggaaagaagcgcttttggccaggattattaagcaaagaacacaatgaaccttgggctacttatatcccttgccaccatatgggaaaagctggcctgagaacaaaaccagtgtagaggaaaatccagctgaccaatggggaaaggcagattccagattacattgtttgagtactaggatccataaaagcctagatttttcatttatatgcgctaacacattccttttctgcataaatcagtttgaattggttttgaagagatacatggaaaatcagaaaataagatatggcagaaattttctcttcccattttcaacactgaactggtatattctaaatatggatatatgggtgttacctctttgatggaagtaaacaaggttttatcaccggacctaaagtctgaacacaaggccatttcaaaggaataaaatctaattttccttaagggagtcaatataaacaaaagaaggtccagggctatattggtgaccatcagaagctagtgcttcagaaagagtgtctcagggtttaaagattctggcatatgaaaaatattactttgagggaaaatccagtacacaaaataaaaggaattctaaagcaaatcaaatgaaagcaaatatagttcactgtcagaaaagataaagaaaaaaacgaaaaatagtacaaccagatatatagttgtataatccaagttttagctaggattcttaaaagtaattgctgacttgtccaccagacagtacaaataatcaataacattctatctcacagttgaattttgtaatcacaaaaagaacaagatctcaaattctctctcaagcatattagaattactgattttatttctttaaatatgtaaatttgtgagtgaggcacttataatttataactttttatgtgagtgaatgcatcaaaaattatgtgtaagtgttcaagataaccactctaaacagaagtaaaagacccgctatatatataataagcaaatgcttagaggtcactataatattcctaggaaaaaagtaaaacttgaaattgcattgcataaaggtctaattgttgctatataaacatatttcacaattttacctaggaagattttaattaataaattcatgtttatactactacctataactataggaaaagcttgtataaatgagaactacaaaaatcaacatgtatatggagaaaaattatttaaattataaaagatattgtatagccaattctacttagctttttaacaaacctgttttctctacttcttgggcacttagctaaaccatatttcctagtcttgcagtttgggacagccatgtgattgtatgactgagtactagtcagtggaagataagtggaaatgatgtctactgtttccaggcccatcccctttaacctcctacctcacctgtatcttccatcatctttacccataccaccttttgacagataagccaagtgaccttgaaaggttgtgctcaaaagggcagagtcaatagatgggagaaatctgaactccccctttgaggagagccacctgctgatccagaatacctgttttagactttaaattgttaagaaataaacttccattatatttgattcattatataatttttattttttaaaatagctagtattaccttaactaatatagcttatgattatatcactaatatgtgatcattgatattcatgattcattttatttttccactaattttaagtttttaatatccctagaactcagtacaaatgcattaacttcaaattataaaatattttaatattcataagtagtctacatcttcagtaaaactattttttgaaatttatttctttgcttaatcccagattctaaactttctttaacatttaattaacataattaaacttattcatggctttagtaatcaattagatctttctttaaaaagatttaattggccaaaagatttaattgtaattcttttttgaaatcaggataatgtaacctcttattaaaataaacaaaaaataaataaaaatcagtatgatacatcagttttgccatattcctataaagcatctcgaaagtaacaaaatgcttcaagaaaactaccataaaataacattaaaatatttaaaagaagaatggtcccgccagcatagctcttattcagtaagaatgaatgtgcagtccttctgaagaaacagatgaaaacaaaaaagaactaccccaggcaagactgaactaaaaatttttctcaatttccagtcaaactgtgttcacttttctaacatctacccatccacccacccattcattcttcttttgttcattgattcaaaaattgcatattggtattatgtggcaggccccataccaggattctgtgatatcacaaagatgaaatatatagataatgccctcaaggggttcacagtctaatatattcaagaacaagaaacaatcagaatttataactacttactacaattacaaccaccataagtactattacaggacattgggactctatattataaaaggcactgggagaaagcctaatacaaattggaatgaaggttcaaaaatgagctaagattagaagtaatgttttgatggaggaggaaaagtaaaaataatgaaattggtttggggcagaggagagtgtgagaactcaggtatagttatacatgctgaaagactggtgaaagagagtttggtaaatttatagaattataaataatggggaaaatgatgagagatgacaacacagccctaaataggagcaagttcatgacatgccttcattttccctattccataatcagatgattgttattatcacactttttcctgtgcctttcacctcatattcaaacaggacagaatcacttttcattttcactgattaaaatatagctatttctttttttaacacacttttataagagagctactatctgtcaggcaacatcccagactctcagatatactgttcttcctaactttctacaacaccttatactatcatttactggactgcttgcttggtaatacactttaccaccctgtatttcaattatttggtaatatatctgttttacctgccaaactccaagctccataaaacatggaaatgcctcagtcgttttttttgtctgccataaaacagtagctagtacgtaatataggtataacgaatgtttactgagtggatgaactaaagcaatgaagaaaaatggattagctttaaaataagagactatcattttagttttctcattacgcaataagattttttaaatatacaaaatatcataatgtgtattttatgtttatatttttatgttttgtaggatattgatactatttattggtaagtaataatattttattattgcagtaccccttcacaatatacccttatatatacaacttataattctgatagtttctgaaaacacattactattggaatgctgctaaaaatatgactagaattcattttttcatccatataaaaatgtttattgagtagttactatttgtaggacactatgtgaattgcttagcttttatatttcattgccattaaatacaataatgtaagaggtaaaatatgtcaaattaacttccctttgtacttagtcatagtcataccctgaggcaaaggaacaatgtcattcaacctcctttcataaataatatactttgaaacaatgactgattcattgttaaactgcatgattatatagtataaagattataaattcagttgaagttcaggtgttttttattatgagatactgtacttttaaattctggaatttccaattaatgtttttaatagatctcatttctcttctgagagtctccatctgttcaaagaaaaagaaaaagtctgagctggagtaagtaaggaggtttctatataaagaaagacttgaactacacctcataagatgaacaagatttaaacaaacagcaaagatgagagaatgaaacaatgagcaaacacaccatgcaagaaatgcctatgatatttttagacaaataacaaaggaataagctatactggtggcaggaaggagaacagaaagaaatatcattggataaggaggggtagtaacagaatcggaagatcttgacattcttgaactccaagaagaggaaggggccacgataatttagttaaaataaggctcaatattgtatcactgctctgtatacttcaatgtgtttttgtagtggctggtaacagtctttccttttcatatttagtgcttccttcagaagctcttgtaaggcaggtctggtggtaacaaactccctcagcatttgcttgtctgaaaaggatcttatttctcttttgcctatgaggacagagtcaaatctacacatatcaataccagccttaaatgtaaataagctaaataccacaattaaaagacacaaagtagggtgggcacggtggctcacacctgtaatactagcactttgggaggccaaggtgggtggatcacctgaggtcaggagttcgagatcaacctggccaacatagtgaaaccccatctcttctaaaaatacaaaaaatcagccgggcatggtgctgggcacctgtaatcccagcaactcaggaggttgaggcaggagaattgattgaacccaggaggcagaggttacagtgagccaagatcacaccattgcactccagcctgggcaacaagagcaaaactccatctcaaaaataaaataaaataaaataaaagacacaaagtggcaagctagataaagaaccaagatccattggtatgctgtttgcaagagactcatctcacatgtaatgacacacataggctcaaaataaagggacagagaaaaatctaccatgctaatggaaaacaaaccaaaaaaagcaagggttgctattcttatttcagacaaaacagactttaaactaacaaagatcaaaaaagacaaaagagggcattacataatcataaagggttcaattaagaagatctaactatcctaaatatatatgcacccaacacaggaggaagcagattcttaaatcaagttcttagagactttcaaaaagacttagacttccagagaataacagtgggaaactttaatactccactgacaatatgagaaagatcactgagacagtaaattaacaaaggtattcaggacctgaactcagcaatggatcacatgaacccagcagatatttacagaactctcccccagaatatacattcttctcattgccacatggcacatactctaaaattgatcacataatttaaagtaaaacacaccttggcaaatgcaaaagaactgaaaatcataacaaacagtctctcagaccacagtgcaattaaattggaaatcaagactaagaaattcactcaaagccatacaactacatgcaaactgaataacctgctcctgaatgacttttgtgtaaataatgaaattaaggcagcaatcaataagttatttggaattaatgagaacaaagatacaacataccagaatctctgggacacagctcaggcactgttaagaaggaaatttatagcactaaatgcccacgtcaaaaagttagaaagagctcaagttaacaacctaacatcacaactaaaagaactatacaaccaagagcaaacaaatcccaaagctagtagagtacaaaacataaccaaaatcagagctgaatttaaggagattgagacacgacaaaaaaaatccaaaagattaacaaatccaggagctgctttttaaaaaaaaaaattaataacatagaacaaatagctaagctaataaagaagaaaagagggaagattcaaataaacacaatcagaaataacaatggggatattaccccgaccccatagaaatgcaaacaaccatcaaagaatattatgaacacctctatgcacataaactagaaaatctagaagaaatgaataaattcctggacacatataccctcccaagactgaaccaggaagaaattgattctctgagcaaaccaaacctctgaaattgaagcaataataaacagcctaccaaccagaaaaagcccaggaccagaaagattcacgactaaattctaccagatgtacaaagaagaaccagtaccattcctactgaaactattccaaaaaattgaaaaggagggactcctccctaactcattctatgaggccaacatcatcctgataccaaaacctggcaaagataccacaaaaaaagaaaaattcacaccaatatccttcaggaaaatggatgcaaaaatcctcaaaaaaaaaaaaaaaaaaactgacaagctgaatctggcagcaaatgaaaaaccctatccaccataatcaagcaggctctatccctgagatccaaggctggttcaacatacacaagtcaataaatgtgattcatcacattaacagaactaaagacaaaaatcacataattatcacaatagatgcagaaaaggcttttgataaaattcaacatccattcatgttaaaaactctcaataaacagactttaaaccaacaaagatcaaagaagggcattacataatggtaaagggatcatacctcaaaataataaggacataccttataatgtccttattttgaggacatacctcaaaataataagagccatatatgacaaacccacagccaacatcatactgaacgagcaaaagctgggggtgttcccactgaaaactggaacaagacaaggaagccctctctcaccacttctattcaacatagtactgaaagtcctggccagggcaaccaggcaagagaaggaaataaagagcatttgaataggaagagaggaagtaaaaccatccctgtttgcagatgacatgatccatatctagaaaaccacatagtcttagcccaaaagcttcttaagctgataaacaacttcagcaaagtctcaagatacaaaaccaatgtgcaaaaataactagcattcctacaacaggcaagtggagagtcaaatcaggaacatactcccattcacaatagccacaaaaagaataaaattcctaggaatacagctaactagggaggtaaaagatttctacaagaactacaaaacactgcacaaagaaatcagagatgacacaaacaaaaataaattccatgctaatggataggaagaatcaatatcgtgaaaatggtcacactgcccaaatcaatttagattcaatactattcctattaaactaacattgagactcttcaagaactagaaaaaaactactttaaaatgaatatggaaccaaaaaagaaccaaaatatccaaggcaattctaagcaaaaagaacaaagctggaggcatcatgctacccaatttcaaactatactatggggctacagcaaccaaaacagcatagtactggtacagaaacagatacacagaccaatggaacagtatagagaattcagaaataagaccacacaccagaaataagaccacacacctacaactatgtgatctttgacaaacctgacaaaaaacaagcaatggggaaaggattccctattcaataaatggtgcttgaataactggctagcaatatgcagaaaactgaaactgtaccccttcctcataccatatacaaaaattaactcaagatggattaaagacttaaatgtaatacccaaaactataaaaaaaatcctggaagacaacctaagtaataccattcaggacacaggaatgggcaaagatttcatgacaaagatgccaaaagcaactacaacaaaagcaaaaattgacaaatgggatctaattaaactaaagacttctgcacagccaaagaaactatcaacagagtaaacagaaaacctacatattgggagaaaatttttggaaactatgcatccaacaaaggtctaatagccagcatctttaaggaacttaaacaaatttacaagaaaaaaacgaccacataaaaaagtgggcaaagaacattaacaggcacttcaaaagaagacatacatgcagccaacaagcatatgaaaaaaatgtgcaacatcactgatcattagagaaacacaaaccaaaaccacaatgagatgccatctcacccaaatggctattaaaatgtaaaaaacataacagacgctggcaaggttatggaaaaaaaagcaatgtttatacactgttggtgggagtgtaaattagttcaaccattatagaagacagtacggtgattcctcaaagatctaaagacagaaataccattcaacacagcaatcccattactgggtatatacccaatggaataaaaatcattctattataaagacgaatgcacacatatgttcattacagcactattcacaatagcaaagagatggaatcaacctaaatgcctatcagtgatggactgaataaagaatatgtggtgcatatatatatactggaatactatgccaccataaaaaagaatgagatcatgccctttccaggaacatggatgaatctgaggccattatctttagcaagctaatgcaggaacagaaaaccaaataccacatattctcacttgtaagtgggagctaagtgatgagaacacacagacaaatagagaacagcacacactggggtctactgaagggttgtgggtgggagaagggagagtattgggaaaaacaaccaatgggtactagactaatagctgagttatgaaataatctatacaacaaacccccatggcacaagtttatctatgtaacaaacctgcacatgtaaccctgaacttaaaatagacgtaaaaaaagtaaggctctcattgatttttgaccgtgaagtcatgaaatacaaactccatttcagaaagtctcatctggcagtataatataggtgtgggttagaattaagagagactgattgcaaagaaaggaacaaaaacattggtttgacaccttctgtgtgtccaacacactgctaaatactttttacacaaagtatacttcaataggaaacagtgagagactaagacaaaatgggaaggttagctataattatggggtaacctttcagtgatacagagaaaaatacatataaatgattcaacaaataaaatagaaatgacaggctaccattcgtttagtgtgtaatctgtggtgagcactgtgttaggtactccatacttatcacctctatcctcacaacaatcctgcaaggtactattattcttattgctaccatttttcatattaaaaaaatctaaacatcagggaaatatttaccagggaaataatacctgcaagatactattactattactattgttaccatttttcagatgagaaatctaaagatcagtgaaatatctacctatggagtagaactggaattcaaacacaagtcttttgaactcaaattcctgttctctaccctataatgtcacatacaatacaaaaatatgttattgaagaaattagtgtaattctttaatgcaaggactctttaatgtaagttagtgaggatgataattactatgacagtaaaaacactttaatgtttgagaaaggggcaccaggctaggtaaaactaggattagagattcaagggcaaaaggaaatctttcaaagctggaatggatttatttcagtaacaaagaatagattataggaaaagatataacatgtcaatttttgtctcatttattctgagggcaggcaattttcactttaatgatcccgcttctcactagttcattttctttgttcattttaaagtctttatttcctgtcggatttattcccttgactaagcattctttctccaaattaagactttgcttctcattattaatgatttgatagcacagactggcagctatcacctaaatggaactgttaggaaactgtaaacaaacacaacttttcagctttaaaaagcatagatggcagatgcaagaattctggcaaagccatgtgaaaataacatcagttttaaaaatctaagcctgagattgaagcaggccacactgtatcttttacttacgattattgattctgattctatcatagagaatcccaattcttcagctgttagaggctgaatgaattccaatattctttagttgtggcccaaatggtctcctgataaaatatgttgaagcatgagcaatttcagcaattttttctgggttactagtctactattccatcagaattaatttgctcttcaaggtgaaaagcatttcctcggacacagagttaagtgattattgcaactgccatgtctctttaagctcaggctctcgcctgatttcctttggcattaggcagcaaaatggatttttttaaatactggcaagctgtccaaggtcttcactcaaaaagagagccaagaactcccaaatgtaaaccttgaaatagaattacaaattaggtacactatgacaaatgaacaaggtaaatgtgaaaagtgactaaaagttaacttcatcattatccagaatgtgaggttaaaagaaaggtgaattattactacattttcaggaaaacattacaattagctcataagtgtaaagtacagattctcaggaaaattctaacagctgagttcttctactagaaagtttaattcaagttagagattataaagagattagaaagaacaaaagtatcaaaacaaaaactggccaataatatatctgaagagtatataaaaatggtaacctcacaaatgtcataaagttcaaaacataaaaattaaaatattttagaaaggaagtttactgcccttaatagaatgctcataatatagatgcatattttaacatcaaacacattttaagcacatgcacaatgaaatactgtgcatcagtgaagtccataaaaatgtgcaagaatcattaacaattagaaaaaaacaggatgtcatcaaccaccaaatatacattcttatcacctgcacagggaacatactcaaagattgatgacatgctcagccataaagcgagtctcaataaattcaaaaaaatcaaaaccataccaaccatatttttggaccacagtggaataaaaatagaaatcaatgccataaacatatctcaaaaccatccctcaaatcttttcaatttcatgaaaactaaacaacttgctactgaatgagttttgggtacgcaatgaaattaaggcagatatcaaaaaaatctttgaaataaactaaaacagacgtaacataccaaaatctctgagatgcagcagaagcaatgttaagaggaaagtctatagtgctaaatgcctacctcaaaaaatttttaaagatctcaaattaataatctaacatcacacccagaggaactagaaaaacaagaacaaatcagaagaaaagaaataaataaaataaaataaaatcagtgcagaagtgaatgaaattaagacccaaaaattcatacaaaaaaatctataaaaccaaaagttggcatgaaaggataaataagatcaataggctggcagctacattaacaaagaaagaagagacaatatccaaataagcacaatcagaaatggcaaaggtgacattaaaaccaatcccaccgaaatacaaaaaaaaccctcagagactatgatgaacaccatatatatacaaactagaaaatctagaggaagtagataaattcctggaaatacaccatatcccagggttaaatcaggaagacattgaaaccctgaatagaccaataatgaattccgaaatggaatcagtaataaaaagcctaacaaccaaaaaaaaaaaaaaaaaaccctggaccagaaggatttacagctgaattctaccagacatacaaagaagagctggtattaattctgctgaaactattccaaaaaattgaggagaatgaactcctccctaactcatgaagccgccatcatcctaatatcaaaacctggcaaagacacacacacacacacacaaaagaaaactacaggccaatatacctgatgaacagagaagcaaatatcctcagcaaacaaactaaaagcagtagtgcatcaaaaacttacgacgatgaaggaggctttctccctgggatacagggttgattaaacatatacaaaccaataaatgggatttaccacataagcagatttaaaagcaaaatcaatatgatcatctcaatagatgcaataaagataccttcaataaaatccaacatcccttcatgataaaaaccttcaacaaattaggcatcaaagaaacacaactcaaaataataaaagccatctatgacaaactcacagccaacattataataaatgggcaaaaactagaagcattttccttaaggactagaacaagacaagtatggctactctcaccactcatatataacatagtactgaaagtcctagctggagccatcatgcaagaggaataaataaaaggcatccaaatggaaaacaaaaattcaaactatctgtcttcactaatgatacgattctatgcctagaaaaccctaaactccaacaaaaagctgttgaaacttataaatgacttcagcacattttcagaacataaaatctatatatgaagatcattataatttctatacatcaataacattcaatctgagaaccacagtaagaatgcaatcccatttacaataaacacacaaaaaacgaaataccaaggaatacagctaaccagggaggtgaaagatctctacaatgagaactacaaaacccactgttcaaagaaatcagagatgatacaaagaaatggaaaaacatgccatgttcatgggctggaagaatcaatatcaataaaatgtccacactacccaaagcaatctacagattgaatgtattcttattaaagtaccaatatcatttttcacacaattagaaaaaaactattctaaaattcacatggaatcaaaaacaagctcgaatagccaaagtaatcctaaaagaatgaagccagaggcatcacatttcccaacttccaactatactatacagctacaataacaaatacttcatggtactggtacaaaaacagaaacatagaacaaaggaacagaatagagaactcagaaataaagccacacaactacaaccatctaatcttccacaaaaataaacaatggggaaaggacaagctattcaataaatagtgctgggatacctggctagccatacgcagaatgaaactggacccttacctttcatcatacacaacaattaagaaaagatagattaaagatttagatgtaagacctcaaactctaagaatcttagaatgaaacctagaaaacaccattctggacataggtctgggcaaagatttcatgataaagacttcaagagcaattgcaacaaaaacaaaaattgacttaaaaccttctgcacagaaaaagaaactataaacacagtaaacagacaacttacagaatggtagaaaatattcacaatccatgcatctgacaaaggtctaatatccagaatctataaggaacttaaaaagtcaacaagcaaaaaacaaccccattaaaaaatgggtaaaggacatgaaaagaagatatacatgcagttaataagtatgtgaaaaaaatcctcaacattactaatcattagagaagtgcaaatcaaaaccattgaatgcaatctcacacctgtcacaatgactattattaaaaagttaaaaaaaaaacagatgttggtgaggttgtgtagaaaagggatcgcttaaacactatttgtgggaatgtcagttaattcagctactatagaaatagtttggagacttctcaatgaacttaaaacagaactaccatttgacccagcaatcccattactgggtgtatgaccacaggaacacaaatcattctaccattaagacacatccacgtatgctcattgcagcacttttcacaacagcaaagacatggaatcaatctagatatccatcaacggtggactagataaagaaaacgtggcacatatacaccatgggatactatgcagccataaaaaagaataaaactgtgtcctttgcagcaacatggatgcaggtggaggccattatcctaagcaaattaacacaggaacagataaccaaataccacttgttcttactcgtaagtgtgagttaaacactgaatacacatggaaacacacatggacacaaagaggggaactacagacaatggggcttacttgcgggtgtagcacgggaggagagtaaggatcaaaaagctacatattgggtactatgctcattacctgggagaataaatcatttgtacaccaaatcccagtgacacacagtttacccatgtaacaaacctgcatatgtacctcactgaacctaaaataaaagctggaaaaaaaaaaacaaaatagccccatctcaataatacagaaagaataacaaggattaattcaaaaatgtttatcacataaatatttaggaattcaaaaattaataatgtaatcagacatatttcctatattcatatactatatacttccttcgtatatgttatcaggaattaaacatggtatttgtaatacaggatatccttctcatcagtgagagtgatgtactattacctaagaaaaatataatttgacttaagatcctagcgatatattgtgaagtcaataatatagtttacaggggtattttatttcatcctcaaagaaactggcgaggtattcattatttgaaaaatcacccaacaggggaagttcttctcagatcataaatattccatgttagaatttttctcatatgcctacaccgaaatacaggttatcaaacagatgtttttatgcccatgacctgttctatcaattcaataaatgtttgctaagcatgtgagtgaggaactatgctaaggacaaatacatgcacacacacagattaatattttccctgtcttcaaggagcttataggcaaagtcaaaaaagatgattcatgcataattaatacaaagcagcataatgatgcaaatagttagatctaaatagaaggatcaaaaatagttttcaataagtagagatggtagggataatatatatagacaaaacatgaacgtggacaataagaaagacagacgtgtttgagagtaatccattttatttatttatttagagacagagtttcactcttgtcatccaggctggagtgcagtggagctatcttggctcactgcaacctccacctcccgggttcaagtgattctcctgcctcagcctcctgagtagctgggatgacaggtgcacaccaccaggcccagctagtttttgtatttttagtaaagatggagtttcaccatgttggccaggctggtctctaactcccgacctcaggtgatcctccagtctcagcctcccaaagtgctgagattacaggcatgcaccaccgtgcctggccaagaataatccattttactaaaatatatttatctaagacattactagcagataaagctggaaaaatatgatgaagctagaaatgaagggtcttgaatgcctgagttaaacgtttctatttaacatttgcagtgaggaccagggctagttttgagtaggaaaatgacatgaccagaatggcacttaaggcatactgacttggcagcattgctcagaataaatatgagcagatgaagaggagagactagaagtgggtggacagggtaggaggctcttgaaataactcaggtgaggggaaatgatggtctgaacccacaaactggcaggaatgatgaaaaggtgagaggtcaatctggaagacagtaatgaaagacagaatgatctacttgtaagacattggacatacattcagatccaagatttaccttttgggcaactgactttactcctgattcccacgttgaggataataaaacctacctcatgggattgttgtcaggaataaaggagataatgatttttaacatgtttacacaatgcctagcatgtagtgaaaatttagtacttaataaatgctagcttctagtgttacaattattttgagatattatagtttggtcactgtttactgatttttttagtagctacatctcactgctggttcacgtagcagttgtagtcatctatataccctaaaacttttgtgtgaactactctctgacattaaatctcccccaccttgtatttataccattgatttttaaggaatctaaatataagattttatactaactcccactgaattctatgtttttaccttgagccaagatttcagcctattgagataatttttcatataagttcaattatttgtcatatttgctattcctccctaacttctacaaagctgattagaatacatatggctttttccaagtaaaatattgactcagaccaatccaagaacaaaatatttcactttcactagagaaatcccctctacgttgacattttgtgactatttagaacgtctggacaaaattggacaaagtctgtgaaacataaaaatcaagatctcttcagcaacataaaagagaacaaaatagctcttttctatggctgacagaaagccagagtaaaatttttttaaccgatgcagaaactaaggcttggaaatatcaagcaacttccaaaggtcaccctgctagtaaattgcagaacagagttgtacaaccaaatctgtaggactcacaatctcatgctcttaactgctagactaagttatctccctaagaaagatggttgagattcccatcatgattgctgggaaaaacctccactttggtctctggaattcatctccaaataattaaatgcattttgcaatgataatggttcatttgcaagaacatatacacttttatatgcagtctttgcctttttatgcatttattcagtcaatgaactttcactgagagaccactacattcaaggcaccgtgtgaggcaggatgtgactacagagatcaatctaataatgaacctactgtcaaaggggtatataagaagtaatgcaaaacatatacacctacaaggcaaggcagaaagagatgtatcaagaatggtaaaaagcaagtgtgctagaagttcagaaaaatgactcttttattctactagccattttctcaaggacttcctagattccctaaggttacaaaaagttcttcctgaggtgagggtaggaacaaaaacttacccttctgattctggatttttccattaatgtacctacagtacatacgtgtggttaatggtattgttttcaatatataaatgcaggtcaacatgatcctagttctacattccctaattcttgcaaaacctgttaggagatttccaaccttagttgaatcaccttgagtcaccacatccaaaaggtctgttcaactacataagaaatagattgttcaggttagaatgttcttttgaacattgtataccactgcttaagatttagcaccactataaaaaattatacatgctaaagaatcagttatgttcctataataagcctctatttacatttcaaaaaatttgcctcccaagattctctaaatctgatggaaattgggtaagatagccacgaagctctctccaaattctgaaattgatgcattcctgataataagctctagaaattgggttagaatgtgtttgaaggtaaactttgtttcagaaacaccatttggtttttaggcaatctaatctgactctactgatctttaaaacttgatgaattttagaactaaattaagtatattttccaaaagtagggacctcactcccagagagtattctcaagaatagcttggcattaaaaaaaactgaaaatccttcaaggtaaatcttgaaatcttaaaatactaaaataaaatacctcacacttcagaaggctgacatgtaattaaatattttgcattggaaaagaaagtaaaataacagaaaagaggcatagttgctgaacaaaattgcacaaaacctgccaatgcaacccctttcaaaccaaaagctttagatgctgcttgtgtcaagagaaaaaaatacataacacgtttcatcccttaagcttcttatttacttcttaaagacatacgctgatgaggtaatgttctattacaaatgtttaaaaaaaaaacaaaaaaacttttcctggtacctggattctgaaatctgctctaatgatctttatcatcaaatttctctatggcatgctgtgttcacatttaagaattgtatagattgtttatacacatggaggaaaaaacatgaatataaggcttgggaaaacataaagagaatagaaaattttttcagatgatttcacattctttcgaaaacctaaatttcatgagttggtaaagaatgttaggatatttatatttcttcaaaatttacattctagattatataatgtcctaattcaacttagaaaatggtttcagatgcatattataagagtatataaaacagactgacttttgaattaaaatgtatgcaagacaaaatgcaattttaacttgagctagcctttatattacatgcaaaacctccaattgaatacattcaatcataataagaatttaatttttaacttatattagtaaaagtgttcaaactaccatattatagctaatattttaatagaaacaaaaatctccgattcaaaaataaaagttcttacataagatggctggttttgtatttgaaattactgaatcagagtgccctctattggaagaaaagagacaacaaaagctaaactgaactaagaatataggtaaaatacttccaaaactcaagccacatcattaatatgtaaaacacattaattaaaaatatggatgctacaaaacatatttccttacatttttatttctccaaaataacttttggaattacttgtcatatcacaatcagcaagttggatgtttcatatcctatgaaattaaattttaactgaacccaaatgctcatcatttaaccagtaatataaataacagacatacagaaatgttttccacatttaatagtccaatataacatagaaatgttataattgaggactgtggtttgactgcagtttggattttccttgatgataaactgaaagcctccttgctatgaacctcatgtcggtgtccccgccaagtttatatgttgaaatcctaaaccccaatgtgatggtattaaggagggggtgttgggaggtcatcagatgataaccccttatgatgtgctagtgttcatataagaaaacatcaggagggctgggcgcagtggctcacacctgtaatcccagcactttgggaagccgaggcaggcagatcacaaggtcgggagatcgagaccatcgtggccaacatggtgaaaccccgtgtctactaaaatacaaaaaattagccaggtgtggtggcacgtgcctgtagtcccagctactcaggaggctgaggcaggggaatcgcttgaaccccggaggcggaggttgcagtgagccgagattgtaccactgcactccagcctgcgacagagcacgactccgtctcagaaaaaaaaaaaaaaaaaaaaaaacacatcaggagaacctgcttttttcccctctgttctttgccacatgaagatacaaccagaagacagccctctgcaaaccaggaagcaggccttcaccagctaccagctctgctggtaccttcatcttgggcttctcggactccagaactgtgagaaataaatgcttttttttttttccaagccacccaatctacgctaatttgttatagcacagataatccctaattcaagagacttttagaagctcttacactggggaattgcagaagtaggctggacattaagatttacgagatttgttccatctcaaaaaattctagttttgtggtgttttcaagacctcagttctgactcatcatctcagacctgaattacctcagaaagatcttggctgatttttggctccctagaccagtagtatggatgttagacctgagaagcttttccaagagcaatgctcagagctacccaaaattattttgatttagttggtctggactggtatctgagggcatcagtatttattttttagagcctctctaggtaaatctaatatacaactatggctgagaaccattgtttgagcctctccccagatcaagcaacatacaactaccacttttattttccaaaaatgtcactttcaggagaactctcctacacaagaatttattctcaggatcaattttaaacttctggctagcctcccaatctacttagctgcctttgttctctgacaatagagttgagtggcaaggggttatggctccagctccagaatgtctgtgttcttggctctgtaattaccgcatgaaactgggaaagtcataaaagctccctgtatggagaaataatactatccttttcaaagggttattgtgaggattaaatcagttaatacaagtaaagtgttccataaattgaggtattatcattacttacccaactttatttcctactactttccaaaacaaactctcatcataaatcattctcaaattatgcactaattctcatctctgtgcttttgcacttactgtttcttcaggctggaatcctttctcaatcatttgtcccaacaaaagtgaaaagcacagctcccctttcaccaggacacagcttagtctctccctacctccacaaagacttcaatgagtatctgtaaatattcactggtctctcccttttaaaaattcctttggccacaaggtagcatactatgagaaatgtggctgagaattaaaaacactggctcagagtttgaatcctcactctgccacttggcagctaagtcattttctaaatccatattgttaggattacttaataagcgacttaaatcacgtaaagcattagagtagcaaatagcaaaaactgagtaagtgtcagttcttatttattcagtgttttatatgttagccttcagttatagtctacacactgtgactgaagtctccttaggataggtgttttgaaacacttgaaatcaagaaccatatctattataaatcccacaactcaaaacatggtaagaaccatctgtattaggtgacctatattaggtgacctgtacttgactaaactttttgcaacatgtaagagtataattgaagcaatattctggaaaaaaaacttttttgatgaatagaaacaaatattcaacaaaacatggaatgaattcaaataaaacaggctacagaaaagggtcaaagtaatttgattactttttaaacattcgctaacaggtttctatcagattcatcttctgaaaggtcagttccaatgatgtcttttatctgcccaaaatcctttagatttttctcatttcttaaaaaaaaaaccaaaattcttagcctgacattcataattatccatgacctgacctcaaactacacttctactctctcatctttcccctttgtaaactctattcttccaaataaacagaattatttgctcttactcatatataccatctgcttttctccctccacataatctttaatattttatagggaaatattttcaaagaacactattgtaaaggtttgtcacaggaacgaagagtggtgttagaaaagcatgagttcagatttcaaaaccttaacgctcaatttatgagcattaatttctttcttgccactatcacaatacagtctttggcttacaaaaaaaattgaacatcttttccccaaactattatcactctctcaaagtcaaaagcctttgccgtaacttcctgaaagatagaagcttgaatcatggtctccaagcagcacatacagaccccagggcatataagatattcattgggtaaacgaaaaataattagagcttctgttttacacttattctctaccttcctcaatttgaatttcttttgttgtgtatgtctcataatttacatcaaatattactagaaatgcagtctatatatatataatttacaaataatcagggatatttgctcaaaatttgtttactaatggtacgtacaacaaaaaagtttggaaaccctggtctaaaaaattagggctttcagaatatctgtggttttacaagtagaaggccagaagctgccagtttacataaatctttgaggatggatctaaaaatataaacactatgtgttgtttatatagcacaaatatgttttaagttctaactaactttcaaggaaatattaaaatgtaactgattggtaacctggagacagcatacacctatttcagattttttaacagaggattttgtcccaacattaaagttactattataaattatttcattaatataaaaatttcatttggtaaaacttacaggtatttacttcagtacatatacaactgttcatagttattcataaagaatttttattggggccaataataggatgtttttacaaaagagagtgaagcacaaaaacaaaatgaaacaaaaaaagcaggccaaggaggtaggactagccatggaactagattagcaagtgctatcccaggaaacagtgtcacagcttactttaagtaactaaattaagtaaatgttctcataatggacagtcactatacttagcaagtttttttttagttttcacaaataatatgacatacttaacacagttcactctattactggcttttgaataaagtatgatatatctgtaacaaattaagttctaaaagtgactacagatttcttatcagaataatgtatttcctttaataccagtatatactataagtccttcctctacaggacaaaaagtaggtttaaatatcttaatattaaactgatttattctctatagtttttcttgcttttgtgttcatataaaaatccaaatgagtgagaatcacccatggcctgacctcaatctatccttctaatcttatctcccctctttcttctttgtaaactctcattcctaataaatagaaatacttgctcttactcaactatatcatctgtttttctgcctcacataacctttaatattttatatggcaatattttcaaagaacactatcataaaggcgttgtcacaggaactaactcatgcttaagattctgagcttatcaaagagaaacctcttgggatttgcataatattataaaaatatgcagactgaactttccacatttctctcctactatgacttcaggaggaagtgaggaaactatacgtgtggctctgctctgttagtctgagttcatagagaaaatggggaagacagtcgaaaggaaggtttttgtctttttttgggaaccaacatcattatgcccagtaaaactaaaggaacacaacaacaacaacaacaacaaataccaaaaatccatgtttttaagaaagagtctaaaagtagagagaccatgaagtgatctgtcaaagcactccttcccctacacatgcactgcgagtaaaaccccaaagaacgtcaggaaaagagcaataaggaaactgacatcttagagtggcggaatctgataatgcaccacatcccatacctcttaagtgtacacactgaactggcaaagacagacacattatcttcattcccccccgccttacttactacactctggcttccatttttcccaagttcttcctctgaaatcttgctcaaattatctaagtagtggtctgatattgtgtggcacaagtcttcaaacgaataatccttttcttgacagagttttatttcatccaagagttttgataattctccagtgacggtttcacctatgagaataattttttcagaagtttcaagaaaggctattgttaaaacttaatgttaagcaataaaaatatgactgctatggtgatagaactcaaaatataacaagattaagcagtcagacactattctgctgaaaacaaggtactcaaccataattagtacaacaatattaatgggcaaaagagattataattttgcctatttttattctttttcaaaatagaaataattattgtaaggttatgtatacatagtacataaaagcatctggaattacaattcccaaagcttcacttattataggatttaatttccataatatttcattggtattttacttcactgacagaattcattagcaaatttgaaacggtgctgagaaacttcttcctaggttcaataaacagaaatagtacaagttatttaaacaaataataacataggtaatcagtaccttaagaattatggtatatgatataaagtaaaaacacaaaagaaacaaacaatatgcatcatctgtcaaacatgaagattttgtagattacatgaaaatatgcacatttctaaacagtctcagaaagataccttatacctgtaatttattctgaaaaaaatgcccagcagttacaatccagattttaatatttttattctgacataaaaacatatttaacatcagctgactatagatgcatggatttatttctggactttattctgttttattggtatatatgtctgttttcatgcctgtaccatactgttttgattactgtagctcttcacaaggtttccaagaacacaaaatgtggaaaagatagtctcttcaataaatagtgttgggaaagtggatagccacatgcaaaagcatgaaatatgacccttatctcatcccctatgtaaaaatcaatgcaaacagtataaagactggaacattaagacctgaaaatatgaaactcctaaaagaaaacatagggaaaaaacttgatatttgtttggacaatgatttcttggatatgaacaaaagcaaaaatgaacacgcaggattggatcaaactaagaagcttctgcactgcaaataaaacaatcaacacactaaaaagataacttaaggaatgggagaaaatatttgcaaaccatagatctggtaaggggttaatgtgcaaaatacataaggaattcacataactcaatagcaaaaacacaaataacctaattttaaaatgggctaaggactcgaatagacatttcttcaaaaaaggcacataaatgacccaaggtatatgaaaaggtgctcaatatcactaataatcaggcaaatgtaaatgaaagccacaatggggtatcatctcccatctattagaatggctattctcaaaaagacaaaagataggaggtgtttctgaggatgtggagaaagggaaccctgtatgctgtccatgggaatgtaaaatgttaaaggctctatggaaaacagtatggagattcctcaaaaaattaaaaatagaattaccatatgattcagtaatcccaccttggggtgcttattcacaggaaatgaaaccagtatcttggagagatatctgcacccttctgttcattgcaacattcttcagaacagccaagacatgaaaacaactgaagtatacactgtcagatggatggataaataaaatgcaatgtgtgtatacatttatatacacactacacaaacaatggactattattcagccttaaaaaaggagatcctgccatttgtaacaacatggatgaacctagaggatattatcctaagtgagatgaaccaggtacagaaagacaaatactgcatgatctcacatgtggaatctaaaaaagtcaaagtcataaaacagagagtagaatggtgaatgccaggggctggggagtggaggagatgggaaagtgttgatcaaagggtacaaaggttcagttatgggggattaataaattctggagatttaaaatacagcatggtgactatagttaataatattctattgtatacctgaaacttgctaagagagttgatcttaagtgttctctccaaaataaaaaataaaaaatactatgtgagatgatggctatgttaattagcttgattttggcaattattccacaaagtatatatcaagttgcacactgtaaatatatacaatttttatttgccaagtatacctcaataaagctggggaaaaacacatttaagaaaaaaacacatttaagaaacatatactccagataaacttcattacagcagggatagttttctgctttgctcactactgtatctcagggctgagaagccctaatcagtaacaggagctcttataaatggatgaaatatagagtataggatataacctattagacttgaaattttcacaactgtacatacaagtctagtatagattccagggctttataattaggtactcacttttggtcttttgggaaggagactcaacaggagatgaaatgtgtgtttcttgtgttgcatcttcctgtacaggctcttcgaggactgtagatcttcccacgccttctaaatactctgtgtgtatacatttttgagattacatacttgaattcatttattttaaaatcaataaattttaagttttacttctggtaatcagtttttcatttattttttcatatcctaaatatatcctaagttttcaaaagaacttcaaaaaaccaaacatatcaaaagaacgccatgatgagctatttaattaaagttgtaattaaaaaaagacactggattatttgggagaaactcttgaacccctttcttctaaaacctaaacttaaaacattctttccttaaaaataaattcacctattgaagatacaataaactccttggtctccttattttccatctgaagattttaaactgtctgaaagatgctttgaatagatttaatccccaaaacaggaatgtcaaattcagatggataccacaaccagccaggtaacataaacgaatgaaatggaataagttcatttcaaaatggtgctgtaatcttgtaacataagcataatttgcatattaactttatttccacaaagaaataatgttcattgccattattcttgaagtaatgtcctatactcagcctatttttcatttttctagttttgatacagatataatattaggaatagcagcttaaacttaaatattgcttactatggacccagcattgttctaagtgttttgtataaattaactcatgtaatccttacaaaactatgacacatgcactaaattttaaagattacaagtaaaggaggagtattattaacttgtccatgttcattcagctaataggtggcaaagccaaataaatataagacaagaaaacatctcacttttctcttaaccataaagaaaacagcatctgaatgtagaaataaatgttaaccaatattcagcctcacagaccatgttgaaccagagaacaaatgaccaatctaaagttcatccctgaaataaaacttcttttagagaaaccaaaactccagagtttgagctaaaatcctagggttttttttgtttctttttggttgtttgtttgtttgagatggattctcgctctgtcgcccaggctggagtgcagtggtgcaatcttgactcactgcaacctccgcctcccaggttcaaataattctcctgcctcagccccccaagctagctgagactacagatatgtgccaccacacccggctcatttttttttgtatttttagtagagacagggtttcaccatgttcgccaggctggtctggaactcctgaccttgtaatccgcccacctcggcctcccaaagtgctgggattacaagcgtgagccaccgcaccctgccaaattctagatttttaaatgttaacagctaattcaatttttatggaaacacaatgtgggctcaaaatatgtgatatatacaaagcatgtgtgctatctgccaaagcgttcagcccacaagtggctagtttgtagcctctgtataaagattaaatgaacagatcccttttcatacagagcatttgcttatacttctttattcaagaacctttttcttaaaatctaataaagaaaatttgtattctcatgccaaacaagtatgtcctcataccattcaaataatttctaccagggaaatccaggaatgcaaagaacagagatgacgtgttcacattctgaaatttgccagtaattagagaacttcaaagatgtactgtatgccctaccacaaattaacatacctaattaatcttgaccatttaggagagcaaagatagttactcccatgtaacaacatttcatcttatataaaccaatgcagtatgtttttaaaaagtccatggttatgtcacaccccattttctagtgggtgacatttattttgcttttcccaaaagacatattacacacatgcttcagttttgtttttttgtttgtttgtttgttttgtttggtttgtttgagacggagtctcgctctgttgctcaggctggagtgcagtggcgcgatctcggctcactgcaacctctgccttctgggttcacgccattctcctgcctcagcctcccaagtagctgggactacaggcgcccaccaccgcgcccggctaagtttttgtatttttagtagagacggggtttcaccgtgttagccgggatggtctagatctcctgacctcgtgatccacccacctcagcctcccaaagtgctgggattacaggcatgagccatcgcgcctggcccatgcttcagtttttaaaagttcagtgagaggcagccgggcacggtagctcacgcctgtaatcccagcattttgggaggccaaggcgggtggcccacaaagtcaggagatcaagaccatcctggctaacatcgtgaaactccgtctctactaaaaataccaaagaaattagctgggcatggtggcgggtgcctgtagtcccagctactcgggaggctgaggcaggagaatggtgtgaaccggggaggcagagcttgcagtgagcccagagggcgccactgcactccagcctgggtgacagagtgagactccctctcaaaaagaaaaaaaaagttcagtgagaggctgggcgctgtggctcatgcgtgtaatcccagcactttaagaggccaaggtggctggatcacctgcgttcaggagttggagaccagactggccaacatggtaaaaccccctctctactaaaaatacaaaaagtagccagacatggcggcaagtgcctataatcccagctacttgggagactgaggcaggagaatcacttgaacccgggaggcggaggctgcagtgagccaagattgcaccactgcactccagcctaggcaataagagcaaaactctttctcaaaaaaaaaaaaaaaaaaaaattcagtgagagtcaaaagtccaacatgaaatacaaagtgcatagagggagaagactaataaaaaatagtatgtgccactcttattttttagcttttattcaatttaattttaattttaatttatataaaaggctatgatgggatttttctctgattcatctctgcatgcatttgacttgtaattaacttctttattgataagaaaattgtaggggcatgaacttccctgaaatattttggaaatagagaagagagcataatggccacatatagtgcatctattccttttactcctccttggcctttgttgactattgtatctacatgttccctgcctgacttggttttaattcatttatctccctgcaaaacaatgctgttcttcagcttcccaactgacacctaataaaacctatctcaccaccctcctctatcatacttgcagccaatccataacaagtgtaggagataatcactgctgaacagggtaggagctaaaggagagaaaaacatctggggtttttaagtaacatgctacatgtcaggcctaatcaccaaacaggaagagaaagcatttaagtctaattttgttataaaacttttagttcaagtggagaagtatgcaagctgcaaataacaaaagtcgtacctagacagttgtcaaactttcaatagagctaatgactgccactaacaacaaatgcacttaaatgacttttaccaaaaactaaggctggtaagactgagttattttataccattggattaggaaggaaataatctgtattcttttggctaaatacaatttttgttattattgataatctagcatttagatacaagctctgccacttaagatacatgaatttgaacaaatcaaatctctcagagcctcagtttcccttatgtgcaaaagtaaaataatatctgacttatgttacttcatagggtcatagaaaccaaagtagtagcaaatccctgaaaatgctgaaagtattattcaaatgtgaaataacacttaatcatcactactttatagccttattaacttccagctcataactacatatttactacataaatatgaattttaaaaatatttctattatcaaatgagtaaataaataccttaacttctttaaaatacttactgagtagttgaaaaacaaaaataaaacattaaaaggtattattatttagtttaaaagtctaccagaaaaaaataaaactagtaagtttgttcaaaagtaaacactaactcaaaatccaaaagaaaactgtaacagttttaatctcatcttaactttaaggcaaactcatccatcattcaatactgtttaccttgtaagagtgttgcaatctggagagatttctgagatggatgttctttcagaatgtccaagacagttctacctaagctatcctttatgttggcatcaattcctgaaagaaaaagaaaaactcactagatatacaccactgaagtatcctcaaaagatactatcactatctaactgctgtaatttcagacatatacagaccaagcattgaaagtgatttttaaaaaattaagttctacacacacacatacacacacacatgcgcacacacacacacactcacacaagattttagcaagaaagaaggcaggggcctgttgctaccaaagattaggaacattcttgatcatcaattaactcttaaagggcactgacccaatgtttaagattgtttttcaggaccctatgatatctttttttttttgagacggagtctcactctgttgcccaggctggagtgcagtggcgcgatctcggctcactgcaagctccgcttcccaggttcacgccattctcctgcctcagactcctgagtagctgggactacaggtgcccaccaccatgcccaactaatttttttttttttgtatttttagtagagacggggtttcactgtgttagcaaggatggtctcgatatcctgacctcgtgatctgcccaccttggcctcccaaagtgctgggattacaggcttgagccaccacgcccggctgaccctatggtatctttgggttataactatttaactcaacagcacactatcacactgaaaaatattattgatttagaatgtgaattcctaaagtataatggtcatgtgatttatattctctgtacaatatggtaaaaatatttagtaaattataatcatgtaccatgtaagtaacataagaacagtcttagaacacttgaatattcacaaagttgaaaaagcatgattattttgaattgttgtccacaaagaatttatccaaatacaaggtcaaatactctatgatatttatttatgcaagattgtatttgtcagtcacactaatcatccacctgacgagcaaacttactgaagtgtgtaactaaaacacctgttattattttagttgtggaaatatatattgtaagaaagaacttattttaacacagcaaatagctttcactgccctaaaaatattatgaattttccaaacacataattgcaaaaaaaaaaaaaaaagccagtttacaggatctggtcccaaatgttagttcattgtaagattattaaatacatgtttaaatttgcataggaatgtgtaaccagcacatattaatatttaggtggtttcctcaaatcatttgttatatcaccacactgcatgacaaagttaaatataaatgaaattttaactttgttaaattgtgtacaaatacaatcacaatacaacagtctgccaatgtttttcatttttttttacagaggaaaataaacacactatagtccataacatgaaaaattccatcagttgtttacaagcatgaatttgtacccatgccttttgatctttaaaacaaatctgaccttaattctagctctatttcatctcaatcagaatgcacatatgaaaataaataagccaactttattgttccttcaaagcactccctttaaaaggttccctttaaaataagtttctgtagcctactaacaatagctactcagttaatgaactaactagaaggacaatttaccttaaagagagggaactcaaatctctgtttaccgtagtccacaatataaaacacagaaaaactattatgttcttcaataaatcaagcaattgtgaaaatttctcaaggatcaattcctctctcttacagaaggcagaaatttcctttttcttttggtagttcatctctaaagtacttaagtgcataaaattgtaataacaaagaggtttgtacttaaaacatctattgcataaaagaagttgcacattgatatcaatgttatctaaatactgaaactcagttctacataatatgaatacatatctgcattttagagtaaaggcaagagggtgatttgtgaagaaaactgtgtcattttcctttgtctattcccaaaatagaaatgttatctgtcaggataagctccatgcagaatcacaatagttacctgtttctaacagaactcgtacaacatccacctttccaaacaaagctgcttcatgaagtgcactccccttttctgtctggaaaaaaaaaagtaagaaaaaagaaagcacggttgcatttggaatgcttacaggttgaaataaaatgctcacattttacatattcatacatatttgctgtaatctcagctctccctaacagaaaggtcatgtggaataaagaagagattctaaaagcaaaatccatcggcttggggattgtaaaatacctctgcttctaaatagaaatttgggccagatgcagctgaggcggatggatcacctgaggtcaggagttcgagaccagcctggccaacatggcaaaaccccgtctctactaaaatacaaaaattagccacaggtggtggtatgtgcctgtaatcccagctactcaggaagctgaggcaggagaatcgcttgaactcaggaagcagaggttgcagtgagccaagatcatgccactgcactccaacctgggtgacagagtgggactccatctcaaaaataaataaataaatagccatttgactttcttatgtgagtatttcaccttctcttagctttagctctccttaagtataaaataagagaagtaatgcccacctcacaaggcttttgtgactatgcaagaagctcatttaatcagcatgcatttattaaacaccaattataggccaagagtagctgatggatattctgaggtatggaaatatcatcctggccctcatatattcacattctatttgaagagacagatgtataaacacagatgctccttgacttccaatagggttacctcctgataaagccaccataaactgagtatcccttaaattgaaaatgcatttaggctgggcgcagtggctcatgcctgtaatcccagcactttgggagccaaggcaggtggattgcctaaggccaggagttcaggaccagtctgaccaacatggtgaaaccccatctctactaaaaatacaaaaaaattagccaggcgtggtggcatgcacctgtaatcccagctactcaggaggctgagacaggggaattgcttgaaccagaaaggtggaggttgcagtgagccgagatcgcaccactgcactccagcctgggtgacagagtgagaatccatcgcaaaaaaaaaaaaaaagaaaagaaaaagaaaagaaaatgcatttaaacacaggtaacctaccaccaaacatcatagcctagactagcctactttaaatatgctcagaacacttacattaacctagtgttgggcaaaatcatgtaacacaaagcctattttatgataaagcattgactatctcatatactgcatatcgctagcctgagaaaagatcaagattcaaaatttgaagcatatcaaaaatgcgacagtttcacaccattttaaagtcgagaaattgttaaattaaatcattgtaagttgggggctgtctgtaaatatttatgataaatgaaatctaaacaatttaatgtagccataaaaaagaataaaatcctgtcattcacagcaacatggatgagcctggagaatattatgttaagtgaaataagtcaggcacagaaagataaataccacatgttctcacatatgtgtgagctaaaaaagttggacccatagaagtagagagtaacattatggttatgagaggctgggcaggggagcagggagaggaggatagggagaggttggtgattgactgcgaaattacagctatataggaggaagaagttctagtattctttagtagggtgatgatagttaacaataattgattatatattttcaaatactggaagagaggattttttaatgttcccaacacaaataaatggcaaatgtttaaggtgatagatatgctaattaccctatcattatatactatatttcatgtatcaaaatatcactctgtacccctaaatatgtacaattatgacatgcaattaaaaataaaaataaatttaaaagccaaaaaaaatttaatgtggcttaagaaacccagatgatattttctccctgctttcctctccgtcccatcctttgcccatcacaaccctcttccaaacctcataccctatgctccaggcatactgaactttctttttttttttttttttttttgagacggagtctcgctctgtggcgcaggctggagtgcagtggcacgatctcagctcactgcaagctccgcctccagggttcacaccattcccctgtctcagcctcccgagaagctgggactacaggctcctgccaccacacccagctaatttttttgtatttttagtagagatggggtttcatcatgttagccaggatggtctcgatctcctgacctcatgatccacccgtcttggcctcccaaagtgctgggattacaggcgtgagccaccgcgcctggcccctgaacactttcataatcatttcatattgctttcttccacagggggtctccaaggctggtctctctgcctggcaggatctaactcctagcactcttaatctagccatctagatatacctaccactagttaattttcagcatgaataagaaccatgtggagaaactgtcttaaaaacatacttctgggccccatccccagagtttctgattcagtcgcctgagattaggccatagaatttccatttctaacaaattcccctgtgattctgtaggtctaaagagtatgctttaagaaccataaacatgtacgatatctcgaatcttagcttaaaataattgcatttataaagacatccctgacccctgaagtttagtgtttttcctggatgttccacatcaatctatattttccttatcacagcactcatataccacattataattttatgtaattgtctggttcccataataaactgtaagttcagcggaaatgtaggccacatctattttttcaccattgtatccccaatgcctagcaaagtactttgaaaatatagatgtttaggaatttttctgagggcaagaagtggagggagggaagaacacaggatgaaaaactaggacaatttgtgagtagtgcaggataagactgattctgccttcaggaagctcaaggaagattccaaagatgaagctttttgagctacacgaatgttagttgtctcttttttttttttttcattctttttcttcttctctcaagaatctaacaagtatcagtaggtcgtgtgtgtgtgtgtgtgtgtgtgtctgtgtgtctgtgtgtgttttcaattgaatagtgtcaaggtagcaattttgttgccctatactaaatgtgatctctaaagtgggattctaatctcaacctgaaatagaaatatcactataaaataacatacaatgtaaaaactcttttttttttctgtttttcttttttgagatggagtcttgctctctcgcccaggctggagtgctgtggcatgatctcagctcactgcaacctccgtctcccaggtgcaagcgattctcctgcctcagcttcccaagtagctgagattaaggcatgcgccaccacgcccagctaatttttgtatgtttagtagagaggggctttcaccatgttgaccaggctggtcttgaactcctgacctcaaatgatccgcccacgtcagcctcccaaagtgctgggatcacaggcatgagccactgcgcctggccaaaactctttaataaaagtctattatataattaacccaatctaaagtagataagtacattattaagcaggcttgaggaacactgaatatcaatgtgatctgactgtatcttcaagatggaatgactgaaatgcccttgaattataatctgactggcatgatatgtagatactgaaaaaaatggaaacaaaaaaataatttgtaaatatacagcacagttttgaaggaaatgagaaactggaaactgattcggctcttaagaaaatatttcaatgtggggcatgaacattttattttttcccttccttaaaaatattccttgaaataatctaattttgctcattctcatgctgtttttcaaccagatttctgattactaatttgattcccttacacttttcacaaaattttggacttgatttcagataaatccttcctgatatagcatacttcagttcattctgaaaacaaaccaaagaatattttaattcaggattgcgaggggaaagaaatagaattccccacagccttagggaaaggcgaggacagaaagtatgaaccccagggggttagctttggaacaggtatttgttccagggagtctgtcaaccaatgctagactagtgcctggactttaaccagccactcaaggtacgagtggcagtggggcagaagacagtctgaagtctaagcaagctgaaagtttaaatgagggacccctacaaaactctaaaacttctaaagaacatcctcagtgaaaattaaaacaacaacaacaacacattgcacagaaggggaaaggatgtctaactaggtcttagttgtagatagagtgaaaaaagtaaatccccctaagaatgcctaaccacaattctacactcacatggtaagtttaaggcaaaattgtacaatctctatgaactccagatcctcatccaaaatgtagaataaagtggtcctgggtttctagtaatacaggcagatataaatgcttagaaaaaagcagatataaatcccctctgtaaaagtacactttcaactcaggcctccaaatattccagcagatgaagctctaagaaatacaaattcaaaattataaattactgaatgtgaaaggaagcatcccaccatgaacaaggattagtaaataaaaatacaaaagaataaaactcacaaaaatttcacatattgaaatggtcaggtatagaatataatacatatgtgataaataagatgaaagaactagaacaaaagaataattatcaaaattgaccagatgtgaaaatgaatcaaatagcattctagaaatagaaaatataatatttaaaatcaatggcttaataacatataaatagctattgaaggggtattaaactggatgatagatttttttaagtacataattgatagggtttggctatgtccccatccaaatctcatcttgaattttagttcccataatcttcatgtgtcatgggagagaccggctgggaggtaatttactcatgggggcaattaccctcatgctgttctcatgatagtgagttctcacaagatctaatggttttataaggagcttttcctcctttggctcggcacttcctcttgcctgccaccatgtaagatgtgactttgctcctccttcaccttccaccatgattgtgaagcctccccagccatgtgaaactataagtcaattaaacctctttcctttataaattacaacctcaggtatgtctttattaggagacatactaataggagacttaattaggagaacagactaatacaataatgcaataaaaagaataagagatgaaggacagagcaaaattgcagaatataagcctacatcatttgtcttccccactggaacaccgaatattaacaactatctgcacacagaagagcattgtcacaagaaccaaaaatcaagtgaacaatcacagtatctggttttaacttcctactgctgaaatagacactgaggagggtggaagagaaagtcttgaatcacgggcgctgcccctctcccattccatggcagtggccatgctgtgcagatagaaaatctgtgcattttaggaagggagaaagcagtgactgaggaactttacattgaactcagtgctgctttgccagagtggacaataaagctgtgtggggttccgccagtgcccacacattgaggggacatttgcaccagcccagccagaagggaatcacccatggaatgtgagtctctcaacaagcctcaccactgcactgcaggctgaagtgctctgggatcctcagtaaacttgaaaggcagtctaggacacaaggactgcaattcctaggcaaatcctagtgctaggctaggcttagagccagtagacaagattggcgcatgacctagggagacagcggcagatatggctaacgaagtgcctatgccattcctccaccaacctcaggcagtgcaagtgcaattcacaacaacaaaagtaacttttcccttctatttaaggagaggagagtgaagagtaaagaggactttgtcttgcatcttagatgtcagctcagccatagtaggacagggcactgggcagagttgtgaagccctaaatcctggacatttctagatgtaccttgggccaaaagggaacccactgccttgaaggaaagaacccagtcctggcaggattcatcacctgctgactaaagagctcttggagcctaaataagcagcagcaataactgggagtacaccatgggccttgttgtctgagaaatgctggcttcaagggtcatccagcacagtcccagctgtggtggctacggtgaacaacttcttctgtttgaaaacagcagagggaaaagtaaaggggcctttgccttgcacctaaggtaccacttcggccacagtaggaaaaaacaagcaggcacacggggtctctgcgttcaggcctaggctcttggacaacatttctgaatctgtcctggaccagaggggagcctactgccctatagggtgagtctgaggcctggcaggactcaccataagctgacaaaagagcccttgggctttaagtaaacattggcagtgacctagaagaaccctcgtggaccagaagtggtggtggccacagggagagtctcctctgcctgtggaaaagggaagaaagagtaagaaggactttgtaatgaagtgtgagtgccaatttagctgcagtaaattagaacatcaggtaaactgctaaggtttttgactctaatccttggcttccagacagctactctggacatgcccagggtctgggggaactcactgccctgaagattaggatacagtgctgagctggcttcaggtctgacccaacacaatcccagtggtggtttccgaaggggtgtttgcatcaccacacccccaggtacaggtggctcagcacagaaagacagactctgtttctttgagagaaaggagaaagaagagtctctgcctagtaatacatagaattcttccacatcttatccaagaccaccaaggcaatacctctatgagtctgcaaaaaccacagtgttagtgggtttggggcccaagtcccttcaaatgcctggaaagtcttcctaagaaggacagatacaaacaggtccagactgtgaagactacagtcaatatctaactcttcaatgcccaaacatcaagaccatccaagaaaacatgacctcaccgaatgaattacataaggcaccagggacaagtcctggaaaaaaaatagatatatgatctttcagacagagaattcaaaatagctgttttgaggaaactcaaagaaattcaagataacacagagaaggaattcagaattctatcagataaatttaacaaagagattgaaataattaaaaagaatcaagcaaaagttctagagttgaaaattgcaattgatgtaatgaagaatgcattagagtctcttaagagcagaattagtcaagaagaaaaaattaacgagcttgaagacaggtattcgaagacacactgagagtctacagccataccgccccaaacgcacccaatctcatctgaaaacacactgagaagacaaaataaaaaaagaataaaaagcaatgaaacctgctttcaagatctagacaacagtctcaagagggcaaatctaaaagttactggccttaaagaggaggttgagaaatagttaggggtagaaggtttattcaaagtgataatattggagaacttcccaaacccagagaaagatattaacattcaaagacaggaaggttatagagcaccaagcagatgtaacccaaagaaggctacttcaaggcatttaagaatcaaactcccaaaggtcaaagataaataaataatcctaaaagcagtaagagaaaataaacaaataacatacaatggagctccaatatatctggcagcagacttttcaatggaaatcttacaggtcaggagagagtggcatgacatatttaaagtgctgaaggaagaaaacttttaccctaaaatggtatatctggcaaaaatatccttcaagcatgaaagagaaataaagaccttcccatacgagcaaaatctgagggatttcatcaacaccaggcctgtcttgcaagaaatgctaaagggagttcttcaatctgaaagaaaaggaaattaataagcaataagaaatcatttgaaggtgcaaaactcactggtaatagcccacagaaaatccagaataaccctgtaattacggtgtgaaaactacttttatcttaagtagaaacactaaacaatgaaccaaaaaataatgactacaatgaattttcaagacacagagaatgaaataagacataaagagaaacaacaaaaagttaaaaagttaggtggcaaagttaaactgtatagtttttattagttttctttttgtgtgtttgtttgtttatgcaatcagtgtcatcatcagtttaaagtaatgggttataaggtagtatttgcaagcctcatggtagcttcaaataaaaaaacatacaatgggtacgcaaaaaaattaaaaagcatgaaattaaagcctactgccagagaaaatcaccttcactaaaaggaagacaggaagaaaggaaaaaaggaagagcagaccgccaaaaaaagagagcgagagaaaaaaataacaaaatgacaggagtaagtccttacttatcaacaataacattaaatgtatatggagtaaactctccaatcaaaagacatagagtggctgaatagataaaaaacaaaacccaatgatctgatgcctacaggaagcacatgttacctataacgatacacacagattaaaaataagtggatgaaaaaagtattccatgtcaacagaaaccaaaaaaccacaagagtagctatacttatattaggcaaaataggttttaagataaaaattgtaggaaaagacaaagaaggtcattatataatgacaaaggggtcaattcagcaagaggatattacaattgtaaatatatatgcaccaaacactggagtacccagatatataaagcaaatattattagtgctaaagggaaagatagacctaaatacaataatagctggagacttcaactccccactttcagcattggatagatcttccagacagaaaatcaacagataaacattggtcttaatctgcactttagaaaaaatggaacattttatctgatggctgcaaaatacatattcttctcctcagcacatggatcattctcaaggacagaccacatgttaggtcacaaaacaaatttttaaacattttttaaaaatgaaaaaatatcaagcatcatccctgaccacaatggaataaaactagaaatcaataacaagagaaattttggaaactatgcaaacagacaaaaattaaacaatatgctcctgaataagtgggtcaatgaagaaatcagaaagaaaatttaaaaattccttgaaataagttcatggaaacacagcataccaaaacctatgggacacagcaaaagcagtactaagaagaaactttatagccatcaatgcctacatcaaaaaggaagaaaaacttaaaataaataatctaatgatgcatcttaaagaatttaaaaagcaagagcaagctgaatgcaaaattaagagaagaaaagaaataataaggatcagagcagacataaatgaatttgaaatgattaaaaaaagacaacagatcaacaaaacaagaagttgttttgaaaagaaaaacacaattgacaaacctttagccagactaacacaagagagaagacccaaataaatgaaatcagaaatgaaaaaggagacattacaactaatatcacagaaattcaaaggatcatgagtggctgatatgaacaactacataccaataaatggaaaaatctagaagaaatggataaattcctacatacatacaatctactaaaattgaaccattaacaattccaaagcccaaacagacgaataacaagtaacaagatcgaagccataataaaaagtctcccagtaaagaaaagtgcaggaccgatgactttgctgatgaattctaccaaacatttaaaaaactaataccaatcctattcaaactgttctgaaaaataggggaagatggaatacttacaaacccattctacaaggccagtattaatctgatactataccccaagacacaccaaaaaaagaaaactataggccaatatctctgattactattgatgtaaaaatcctcaacaaaactccaacaaaccaaattcaacaacaaattaggatttatccctgtgatgcaaggatggttcaacatatgcaaatcaatcaatgtgataccctgtatcaacagaatgaaggacaaaaaacattatcattttgactaatgctgaaaacatatttgatgcagtccaacatcccttcctgttttaaaaaaaaatagtcaaaacacctcaatgtaataaaatccatatatgacagactcacgactagtatcatactgaatgggggaaaactgaaagcctttcctctaagacctggaatacaacaagaacacccactttcaccactgttactcaaaatagaactggaagtcctagctagagcaattaaacaagagaaagacataaagggcatccaaattggaaaggaagaagtcaaattatccttgtttgcagataatacaatcttatatttggaaaaacctaaagactccactgaaaaactattagaactgataaacaaatgtagcaacgttgcaggatacaaaatcaacatacaaaaatcagcagcatttctatatgccaacagtaaacaatgtgaaaaagaaaattttaaaaatcccatttacagtagccacacataaaactaaatacctaggaattaaccaaataaatgaaaaatctctacaatgaaaactgtaaaatactgatgaaagaaattgaagatgacatcaaaaatggaaagatattccatgctcatgaattggaagaatcaatattgttaaaatgtccatactaaccaaagcaatctacagattcaatgcaatacctatcaacataccaatgacatttttcacagaaatggaaaaccaatcccaaaatttatacagaatcaccaaatacccagaatagccaaagcaaacctgagcaaaaagaataaaactgaaggaataacattacctgacttcaaattatactacaaatcagaatggtactggcataaaatcagacacatagaccaatggaacaaaatagaaaacctagaaacaaatctacacacctacagtgaactcattttcgacaaaagagccaagaacatacactggtgaaaagacagtcttcaataaatggtgctggtaaaactaaatatccatatgcagaacaatgaaactagactcctatctctcacaatatacaaaaatcaaatcaaaatggattaaacatttgaatctaaggcttcaaactctgaaactgctaccaaaaaactttgagaaaaatctccaggatattggtctcggcaaagatttcttgagtaataccccacaagtacaaacaaccaaagcaaaaatggacaaatgggatcatatcaagttaaaaagcttctgcacagcaaaagaaacaatcaacaaagtgaagagacaacccacggaataggagaaaatatttgcaaactactcatctgacaagagattaataaccagaatatataaggaacaaaaaaactttacaggaaaacatctaataatacaattaaaatattggcaaaacatttgaatagacatttctcaaaagaagacacataaatggcaaacaggtatatgaaaaggtgttcagcatcattgatcatcggagaaatgcaaatcaaaactgcaaagaaatgtcacctcaccccagttaaaatggcttttatccaaatgttaagcaataacaaatgctggtgaggatgtgaaaacaagggaatcctatatactgtaggtgggaatgtgaattagtacaaccactatgaagaacagtttggaggttcctcaagaaactaaaaatagagctaccaaatgatccagcaatcccactgctggatatctaccccaaagaaaggaaatcagtattttgaagagatatttacaatctcatgtttgttgtggcactgttcacaatagccaagatttggaagcaacctaagtgtccatcaacagatgaaaggataaagaaaatgtggtacacacacacacacacacacacacacacacattttcttggagtactatacagccacaaaaaagaataagattctgtcatttgcaacaacatggatggaactggagatcattatattaagtgaaataagccaggctcagaaagacagacatcacatgttctcagttatttgtgagatctaaaaatcaaaacaattgaactcacagagataaagaagggtggttaccagaggctgggaagggtagtgggggcacaggggttagagggaggtggggatggttaaagcgtacaaaaaatagaaagaatgaataagacctagtatttgatagcacaacaggggcactataatcaataataattcaattgtacatttaaaaataaataattgtaacacaaaagataaatgcttgaggggatggatactcaattttccatgatgtgattattgtacattgcatacatgtaccaaaatatctcatgaacccataaatatatatacctactatgtatccacaaaaattttacatttaaaattttttaaatgactacagaaacaaataagcaaagaaggtaaaaaagaaataagagatggaaaatatgaaagatagaataaaataagaggattcaacatatgtctaatcaattttagaggaagaagatagaggtaaataatagtcagtggctaagaactttacataattgataagacactaagttccaggaccagcaagcaagataaatgaaaagaatacatcctggacatatcacagtaaaactacaaaactactaagataataactttaagacactctgagggaaaaaattgcctaaaaagaaataataattagatcaatagcggacttcacaacaaaaataaataataaagtcagaagaaagtataataccttcatgtgacaagagaaaaaaaatctatcaacctagcattctacattcagtcaaactaccttctaaaaatgagagtaaaataaaaacattttcagacagactaaaaatgagtggttacttacaactcttactgaaagaacttctataggatataattcagaaaaggaactgagatgcaagaagtaatgataaataaagagaatggttaatatgaggctaaatctaaacaaatatttaaaaatatgatagtgtctacttttggcactgatttggcttcacagatactttgataaaggatgatgcacactgtagacacggaaaaggtcccactttatacacagggaatatattccaagcaccccagtggatgtctaaaaccaaagatagtactgaacccgaatgccatcaatcagaattcatttctgttcatgtcttccatccacaaattcaaggccttttccatcttaactaagcacttaccgtgcactatagctgtaacttctgtagtttgaggtgcaacagcaaaactagtacaaatttctttttctttcttctcaacttcagatagaggattcattcttaccatagatcttagcaacctctgtgtacaagtttttcttttctttagtaagtcaagaactttcaccttttcacttagaggaagcactttacagcttctctttggaatatgcaaattgtcagcatcactgctcttgtgctttggggccattattaagtaaaatatgggtgacttgaacccaagcagtgcaataccagaacagtcgatctgataatcaagagggctaccaataggcaagtagtgtctacagcacagagatgctggacaaagggatgattcatgtcccaggcaggacaaagtatgatggtgagagttttcatcatgctactcagaatggcatggaatttaaaacttataagttgtttatttctataattttccttttaatgttttcagaccatggttgactgcaggtatctgaaacagcagaaaactaaacatcagataaaggttgggtgggcggcaggggtagggggaactattatattctagacaatgaaaatacataatctccaccataaataaacaaatctctttctggaaaaagcagatggagcaaacctgggttccagtggcagcttggcttttagtatctctgaaaattcatatatcctatgagaaacatattaaaaacctaacagatacatccatgttgtgtgggaaaaattaaaaataaaatacaaattttaaaaacctaatatggttattgggaaggttaaataagataaacatacaacaaataagattttttaagtgttttattaaactataaagtaatgacaagtattatcaataatatttctattaaaaaagcaattagaaaacctattttaaaagtaacctcaattatgttaatattaattacatacatgtatatcctttacattattccaagataaaaatgctatgttaagtagaactaatgttttcatacaataagaagacacagaattcttcaataaaaacagaaaaggttagtagatgataaacatatttttagcctgtaaaaatgaatctgtttttacaaattcaaggttgctgtaattagcttctttggtaagagaacatgagaactgtcaaatggaatggattggtctcataattctaaggtaaacaatggtaccaagaactatttactgctatcacaatgttgtcacatagtgtacagaatgtaaatatgtcaaacccatggacttttcaaaatatagattaattttgtaataatttccttcttttcatcagagattagaaaaatttaagaatattttgccaaggtgtaaagtaagatttaaaaaaaaatcaagtgccttgtggcttatcacaccctagacagagtccgtgtctaattgtctaatattctcactcaaatgagcactattctgtacatctcagcattctgccccaaatctacaacccataaccggccagaccttgaaaaattctattcttgtgaaatatttagtccaaaacattttacaagaaagtaggaagtctacaaagaaacaacactgaacaaggtgaacccaaaggctcccatccctggagatttcagtcctgcttttcttatggatcaaaattctccattttatttaaattaatcatttaaaaaaaacaaaatttccaaaatcgataatcatgcagtttataacacagtgacatttcaaaacttatccagtaaccacacataaagcactcataacatctcagcaccttttaggggaaaaaaaaaagacaaacctctgaacacagtgatgaaaacagctgagcgaaaagtactgaaatgatatatatgttaacatcaataactgaattgttgatgaaagcaaaagaaattctctcattgattggaaatgcctgttaaagtcaagccttggtagcaccaaagctgagaaaaacaagataagtcgcaagcaaaagggagagaagatgacgttcatgtttacagccctgggtttcagcttcccttctttttggcgttatatatttctgtgacttccatggaagctcagttgtgcatttaaagggatgtttgttatattttatccaaaatttctagatgttttaaagtcgtttttaggttatctattctaccagagtgccaaaacagcagatggaaaagggatgcaaagatgtcagagcttagctgcactggtttccccttccaaatttagcactccaaccataattatcctgaagcctgcgaaagagaataatgagataaagaccgattcttgattaaaggagaaaataaagataacaattatgataagcaataatgattgtggtgacgatcagcagagaaaatagcacagatagcataaaactgtgagaagcaagacccacaactattgtaacaactggtaaataaagataaccttactggagatgaagaaaaaacaactagaatggcatttaactcagaaataaaattccctagtaccctgtttggtacttagccacgtgggcacctcttggaattaaaaaaaaaaaaaaaaaaaacaaaagataacaactcaacttagtgtttgacaacaaacatatgatgtctgaacaagttggaaggcagcagctcttttgcattatctagaccatatctagaggagtatgttcaattgtgggtatctaacttttaggaccaatgacagaatacaatgtgtccagagaagagagtgccaaagaataaaggacctagaaaaacatcgtgtgaagaataaaggttataagaatgtttaaactgggaggaaaatggcacaagagaaatatgacatgtcttcaaataattcagaataccattgttgctattcaaaagaagaaatctccctctattaaactagggacttcaagtcttggtctttactcattctctcttccttcacttcatatcaaaggaagcacccttcttttcattaacattatttctccacttgtgctctttattctatcactttctgctgcttcttgaattttgatcatctctgcctcttgcatcttcaaggcaatctttctccataaacatacacacctttccactatttaaaaacaaaacaaacaaccaaagaaacttcctgtgaacctgctttcacttcaagcttctatccgctatcttacttttctttattccacgctttatgaaaagtcatcttccctcttttaggcacaatttttgcctagttttgttactgctatatcctctggcacatagtaggcactcaataaatatatgataaatgaattgattacatgaaattgtgctgtcttggcattcctcttttaactgcttctttacagacctttttccagaaactccctgaatattctttaatcagcctcttctgtctccctacattctgtttcttgtaagcccttctatctcatggcttcatctcttactcctctgaggctagcctcttagaaagttagcctcatttaaggagcacatccaaagagagacctctctgacccttccgtctcaatcacagcacccagtttgtttccattatagcactcactgcaatttatcatttttatgttgtttatgtgcttattttctgtcatccctactagtctataactccatgggagcaggaaacaaattttcttcctcctggagcatagtgcctggtagcatggcatgagaagtcaggaggggctagggtatcctcatagggaagccagggttcagttaaaagtgaaagaaagggagttgcttgggtagtgagtaaggtaagtaaaggaaggcctcactattaaggtgacattggagaagacacctgaggaaagaagggggaagaaagtcatgagggttagtaaggcagaggcctggaggtaggagtgtacataatgtgttccaacaagaacaacaaggtcactgtggatgaagctaagtgaagaagggcaaagaagagtaggtggtagctttagagagacagtgaaactaagtaatataaaaccctatcagacactataaggactctggcttttcctctgagtgaaatggaaaaccaatagaagtgtttttgagtaggaaaatgaaattacctgactgaatgggatcacttctggctgtttgactgaaaatagactgaagggaatatgttatggattgaatatctgtgtgccccaaaactcacatgctaaggccctaacctccagtgtgactgtatttggatatatggcctttctggaagtagttaaggttaaattgggtcataagggtgtggccctaatccaatggaactggtgtccttataagggaaagaggaaacatcagggaactctctctccattcacgcacagaagaaaggccgtgtgaggatataacaagaaggcagccatctaacaagccaggaagaaagccctcactcaggaatggaattggccggaacttgatcttggactttgtagcctccagaattgtgagaaaataaatttctgttgcttaagccactcagcctataatattttgctgtggcaacctaagcagacaatacagaagccaaaaaaaaaaaaaaaaaaaacggaggaaaactagtcaggaagcaagagatgattaggtcttggactatggtgttaatcttgaagataatgtaaagtagtgaaattctggatacaatttgagcacagaaccaataggatttgctgaagaactgaatgtaaaatctgaaagaaaccgtaaaattctgggccaaacaactagaaggatggcactgccttttgacaaaatgggaaagacttggtgatatgcaaatttttgaagaaaggggtacagatgctagattttcagctttggaaatgctgagtttgagaagcctattagtcatctgatagatatgtccagtagggaattacatacacaaatttagagttagggtggagtctgagatgaagaaatagacttggtaattgtcagataaagatgatattggaactcaagagattggatgaggtcaatgaggaagtaggtatagacagagatgaaaagatgtttgagtactaagccctgggacactccgatgcttagagatcaagaagatgagggcagttaactatggaatagggacacgatagattacattattggcctctccttttatatgctctttgccgtatgactttgtacttctttccacttatatgagttgagtatatttctcttcctctttatttgaggcttggttttgtgacctgatttagccaatggatggtaaccaacatgatgcaagcagaggcccaaactgtgcttgcatgattgagctttctctcttatgcacaatcaatgcccccctgcctagtcccaggaggaagataatagacacgtgcagcagagattcccaggctaacttacagcatcaaacatacttcccccagcttcttcaagaagtcaccagtgaactaaatgaaaaccaaaagacagtcgtatctcagaggtcaaaagaaaacggtggttcaaagaagagacagatactgactttgtcagtgctgatgatgaatcaagtaagaggagaagcaggaattgactgttggatctaaaagtatgtcagtcattagacaacttgacaaaggcaaaaacaaggacttttaaaagtgagggagttagagtggcctcaagagagaatggaggaaagaaattggatacaatgagtaaaaacaagcttttctaactacgttgctacaaaggggtcagagaaaggggatggtaaggagaaggaaatgtgagatcaagagagtttttaaaagatgagaaatattacatctttgcatccttatggaaatggtacagttgagaaagaaaaaacgtatggtattaaagacagaaaatatttgtcagagttcccacgtggacaagaaaggataggatccaatgaacaagtagagaggaattagccttagatacaaacctaaaaggttcatttaaagcaccaggaaggaaagtagacacaggtacattggcagatgtggtggtggaaatttgtgattgcttgtggtttcctcagtgaaataaaagcagtatcatgatcagagagggatgatagagaaggaggtgttgaagttttggaatagagatgtcgtgaaattatcatctagggaaatcagagagtaaatggattataatggataattatcgcctatgtacatatcttatttctggtgccactataagcctttgagagcaaaagctgtatcttacttagttttgcatcttaacagctcttagcatggaaacttgtactttttattattaactttctgtaattttactttcatttcctttaatagtcacataaagtctaattggcttaaggttgtactagttctttaactcttcaagtcttatgagagaaacttataagaaactcacacaatgaaagcactagcatgatatggcactatcgctatctggttacccaaaatcaagttcaaaattcataaaaataattgctaacttcaagagaaaactgcccattcaaccctactttcttaatatcttactttgactgattctctttattaaaaaaatatttaaagactaaagggtttataagtaaagatgatatgaaatttgcccaaagtattacttactattttaaatatgtgttataatttaaaattactcagagagtaatgatgcagaaaataaacttctagagcaaatattaacatcaatgctgcatttaaaaacatatgtaggtcaggtgcagtggttcaaatttgtaatcccagcactttggaaggccaagaaaggaggatcacttgagcccaggagttcgagaccaacctgggcaacatagtgagaccttttctctacaaaaactaaaaaaattagccgagcacatcagcacatgcctatagtcccacctactcaggaggctgaagcaggaggatcacttgagcttgggagttctaggccgaagtgagcatgattgcaccactgccctccagcctgggtggcagaataagaccctgcctttaaaaaaaaaaaaaaagtaaaataaaataaaatcacatgtaactactaggaaaagacaagatcctcaaaagccatctataagttttaaagatttattcataataacttgaatgtaattgaagtctaaaagtacaatactataatttaccaaatgggattacttttaatactaattcccaacaggttagctagagcagtttaatgaatattaaatctactgaaacaatttgaggctactagctacattgttcactctcagccagtgagaatatcaacaaacctacttgatattcaaaaattttgcactgagtctgatgggaaaaacttggtaacaattaatttgagtaataaaattaaatattcacccccccccaaaaaaaaaggcaatgagaccaaaaaaaaaaccaacatattttctatgaacaaagcaacaataacaaaagcaaaatatcaactaaggctaaatatattatggaagattcatttcattgagatatattttagaaagatgttgtcagttctacttcctagaattcttagaatgagtgtcaatagaagaggttatagcaacacagaagttgtccaccttactcagacatcaccccgatacttctgattaggtgttcaaagtgatctaagcatattgtctgcctttcttctgatatgtgaagaacaaatctaaatgtggtgaggaccaagcagacaatctaaaggaatgacaatggcaatgatataaaatggtagaatgaggtcggagccttggaaagcatttaccccatctaaaagcactcaaattcaatattttaaaatactctttagccaaataatgcacatatgcaagctaaaggccacctaaaattcaaagtcgtgttggactttcaaaggtccccttcaaatgtcacttccatcaatgacttctcatgttctccctcttaaaatccatattttcctcacccgtagatccacagctctttgttttagcatttattatatgtcatggatgggagttattcttgcaaattttttgtctcctccactaagcgtggggcagagatagttttggttttttattctccaaaagcacaaaatacagtgttttgcagaaaaaaaggacacatcatatacatttataaaattgaatttaaactctttcccttctggtcatgtcatctagtacaaaacatgaaaggatcttggtcagggataccaagaagcttactgacctcagtcagaggggaagtccttggttatattgcagtctgtgcaatcaagtttaaaaatattacagaagtgtgaaagcagtacatccagattagagaaattcaacatttatacaataaacatctagtttatcattaaacaacttttaggaaaataactttgtgagtcacctacaatagtaagcatacctacttattttcaatacccctttgaggagagagactgtttttccttaatatgactgttagaaaaaattcttatgcttttttgagaggctgccaaagttgaataaataagaaattgagaaaagatattacaaatatctaaactactaaataatgcaggcaaagctctaaagcaagctctggttcagggtgctagccttaaaactgagattggaaggcctgagatttttctaaattcaataaagaaaactctggaaatacaggattcaatctctgaacaattcctaggaaatataaccccatctgtgagcacgcattccacctggagtgtgtaattatttgcaacatttgccacatttagtccctctgggtattcacacccttttacaattcacgccctcttctaatacagaggtagactctattttccaactccttgaatatgggttgcctttatgacttgcttcagccaagcaaacatggcagaagtgaaggtgtactagttccaagcctaggcctcaagaagccttgtacaattctgttctctctctcagaaccatgcatgccatgtgagtaagcccaggctgacctgctgaatcatgacagagaagtggcagtctcacctatcaccctagacaacatccagccagcctctgaaacagaaacacataactgatttgcagttgatttcacacacaagagaacacagccaagaccagaagaaccatcagttgagcttagactaaattgccaatcacagaattatgagctaaataaagagttattgtgttaagctattaagttttgggatagtttgttgcacatcaatggcttactaataaggggagaaggtcacaatatgacagaaagcaaaaaagtctctggaagataagaatgctgccattaacttggaagccaagaaataaccatgaaaggaggaaaaggcaaaaaaaaaaaaaaaaaaaaaaaaagactaaccctggagttggggctaacttaagacaagatatcaaaagtaggctgtggccaggcccagtagcccacacctataatcccagaacttggggatgccaaggtggaaggattgcttgagcccaggagttcaagactagcctgagcaacagagcaagacctcatctctacaaaaaatacaaaacttagctgggtatggtggtgtgtacctgcggtcccaccagctactggagaggctgaggcaggaggatcacttgagcccaggaggtggaggctgcagtgagctgagatcacgccacccaccactgcactctagcctgggcaacagagcaagactctgtctgaaaataataataataataaaatatactaaattaaattaaactttttaaagtaggttgaccattccttgtggagaaacaaaacctatccaaatcctattcttcctacaaagctcacctcaaatcacaccttttccatttttttttttctgagtgtccttaggcatagtgatcattccttcattagttatgtataaacagtacattacggtggaaagaggcctggactttaatcagtaagtctaaattcacatcccggttttatcaactatgtgtccttagacaaatttcttaaatctttgaatctgattcctcatctcttaactgaaatttaatagttctcaatcccaaaggacagttgtgagaattgaattctaaatgtgtcaacatgctaaacacaaagtacatactcaacaatgttaaagtgaattttgttccattcattcattaaactctgactggattcctactgtatgttaggctgtgtgctagatattgggacaaaggaaacaattactaatgataccacacacaactgccatctactaacttctcatgtgtatagccctcaaattagaatgaggttagagattatgccttgtagctcttcatatttcccaaaagtaggtggcatagtaccttgaactcagtagttacaaaagtacttgtgaacaatttgattaaaagatttctacatacaggttttcacatttgaatcccaaagccaagcaacagcatcatcacttttaaagcatagctaaaagcacactcacttgacagctcacatccattcctgcctccagcagcacctgcacgactgctttgtggccattgcgcgcagcaaggtgaagtggcgtgtgcttgcgagtgttgcagctcattaagttaggatgtgcactgatgatcatttttaccactctaagccgtccgtagagtgccgccaagtccaaaggtgtttccagcttgctatttctaattgtcgggtcagtgagctcttctaggagaacagcaactacttctgagtgtccatattgagctgcacagtgtagggcagtttcattttcattgttctaagacaaagatttttaaaaaggcacattttcagaaattcaatttgttatcaaaatcttaacacagtaatttaaaacctgcaatgctttgaaatgtaagttaagatttatccattttaacaagtatgcctaatggaattttatatttgataaaagtatctaggattcattgaatcaaaaaaaaattttttatatcactttaatcgaaaacaatccaacatttccctaaatcatatatgccaacttccaaaaatgacaaatgatttagccatgtttgtcagaggccctcctgggtccagaaggacagtgatatctgcatggtgcatcacatctttagacatttattaataagagagatcaaaacaattataacagacttttaatagactggctttccaaaagacagataagaaggtaaattcttggtaacaaaaggtttatagaaaggtttcccaaattaagtttcattttattttccatgtaagtacaaatcattgcttcctttgcaaagaaaatgaaaagattttggccttaagatataaaagtacctttttgaaatgttatcatgggttgtgaggatggacctagatcagttcccagacaagttactaggagtatcacagtacaacatgtgcagcttataagggttcagttgaaaatcaatgagattttcctagaaatgtatcaagatttttaaaaatgttaagatacagaaaactgaacccagttgcaaggcagagggacccttcagactatttgagcaatataggtagatggtgtataggtatgtcaggaggtggaagggtcaggagaaaaatgaacaagaaattttagtaacaaaaatgcaataaccgtaaatgagggttctggaaagaaagagcagctgccaccatcagagttatcatcatagctaacactatgtactagacatagttgcattttatatatgtttactcatttaatcctcattatgagatagatactattatcattatctccattttacagatgagaaaactgaggcactgaatagttgaataactggccttccgttatacagccatttagtggtaggaccgggatttgaacacaagtagccaagacccaaagtgggtgttcttaaccatcacacataccaccttccaaaataggaactattactactactacttgttgagtgcctaaaaactatatatattgtctcatttaactcttacaacaattctccaaaatttatattaaaattgtctacttcatggacaagtaaactaaaatacaaaaaggttaaattacacatccaagtagaattaagatattttgcaagctggatctgacaaatccaaaacccatgctctttccactataccatgttgtctgccatgtgttgctatattgtcaaagaagagctgggaattagtgatctgaaagcagaatttctagaggttttgctcagaaaaataccaaccgagaatagggagtagctgtttagatagctgttctgatgaaaataaaaggataagaagtgttcagacccaaacaaatcttaatgttctagaaagtaactcaagtttgccctggatgatagaagaatgcaagtaagttgagagtctagagggaagatttgaaaatttaaaaaggagtagagtgacaaggggaaaacagcactaggaaaggcttcttactactttaccttgcaaataagtatcaagagagagcatttgaaggtcaaacccacagggaaaaatctactctttcaagacaatcaatgaaaagttaagacctgttagatggggaatccagctgagggtactgtttcttccatcatttgtcaggagtccttctttacttggtttgaaagtattactataatctacttcttcataaacaatgatcacatacaggtttagactccctggtcttcttatctgtttttcttatcaggcttataaaacagccaatcttattacttcacaccatgaaaacattatacagatatatacctcctgaccaacccaaatttccccctggtctgaaagggattcaatctcagttttcaaaatacagtatctctttgagaaaagagaaaggccagttatgaaataatgattcctcaaaggcctctctactggtccagagccctgagcctaggaaattacaagagcaaaatcgaaaaattttctagtaacaccaattagcactgttcagatctcaagggaaaatatatcaatcattcaagacctactcaggataaaaagttcacagattttatccatgatcatcacatacttggatcgtcacctcagtggacgccacaacggtggtacttttacgagagcatgattgtgtatttgtgtatgctcacaagtgatctaaaataatctaatttgaaataaataggctgtgatgaggcactgattaataattcctagtatggctatgcagaatattcttaaaagttttttaattccttcttttttaccaaatgggtattctctgaaacattaggacccttccagataatggatgatagaacaaaactggctaacaaaagccatttaccaaaaactcttggttcagagtaaaacatctaacaagagttggattcgagtttcggtgaatggcaaaggcaatgtgtttttcagataaggcccctctgggttttgccctaatgttaaaataaagaaaaaaaaaaagaggaagagaaggtaaagggaagaaaggattaatgaaatttaaagaaattgaaaattttcaatttaaaggaaatttaaattgcaaaaaggaaataatcagatgataaaagagaaggatgtggcaattataaaaaccataatccgggtagagtccactttgtttagaatggtgaacaagacctaggttgaagtgttaccatgtaaattacttcatctctccaaacctatcttatctgtataatgagaatattattttccctataaaccttataatatagtttataaaccaaaagagataacatatttttaaaatgcattgtaaactttaaatattaaaatgtagaatagaattatttttaaagaaagctgtattagaaaccaaagataactttcagaaatcagaatgaagccctgactataatgcataattttaacataacataaatgtattactggttgagagcttaggctttggatcagaaaaacctgcgttcaaacactggctgcatttcttagtagctgtgatgttacggtcaatctactctatctctctaaggctgtaactccatatatatagtagcaacagtaatctagggcttagtaagataacggggatgaagtattttgcacaatgcctggcacacagtaaacaatccattaagtgataggatttaggatgacaataccaatgcgctgttgtgtaaaaggctctggagtcaaagtcctgagtctcagtctcagtttcagtcactcagtaacacgtggccttcgacaagttgtttagttttacagagcatgatttctcaactataaaatgcgagtgatattatcaattcagaggattattgtgagaattcattaaatcgtatttttgaggtgaaagtgtttagaacagtgcccgctttaccttatgtctcaataaatgctaattaccatttttatttcctttattgtttaaatacataaaagtttataattaacaagaagattctgtcctattcagaaggaaaaaagaaagctaaaattaaaagttatctataaaaataaaaatcctacatcaaaaaatttaggagaaatggcatagaatgggaaaactatgatcagcatcaaaagagtatacatataacaatgaaaaaatactaaaattatggtattaaaaatcgtaagaaagttgcaacttcttgccaatagaaaccgcaacacaaagcaacagaggtgaacaaaggactttgaatatggtctccttaaaaagacactttttgtaatttaattgatctattcaacattaccaaaaacaagtatttctctttaaaacatatagcaacttttcactttcaaatgtaagtgaatactatatgttatttcttattttcatgtcatttaaaaacatcttgtttgtaaaaactaacatcctcttgtttaaccttggattgtttttccattttattatttcaggtttgctttgcagtattcagacaattttaagaataaccaccagatggctcatctcataaatgatctaactgttggttttctgtggaagagaagagcattgtcataaatttccttttagcatgatatgatgataaagatagccatatctgtcatgttttaaagactgggtgcattcttattaaaatttctgcatttttgtaacctgtaaacatggaaatttttattgtgataaatattaataagatacttttccaattaataaaatgttttcctgattagtcctttcaacaactgcatatatattttcattgaaaaaatatgtatttttcttccctttgctatttacagcaattgttactttttatccttcagtctgaatttcaaagtccggcaaagtctgcatccatttgaacaatatgctaattgtgctttattagatatgcttgccctaaagtaacctacttgcattgatattggacaactgccaacctgcagcttaatgccgtgattgtaattcaattgttggactgtctgctggttttcaaatatagttttacaaaatgggaacagtagggggcatgcagagatcaacatgtttgttatcatactgtattaggggaccatattttactttctagaatctgtggtcctatctgtttagaatactgacactggttttctttttaaaatatgtccattatgtgtaatatagatattgtgtacttacaaatacattaactgtcagaatcatactgctgctgtgttttattcaacttattctgggcatatgtgtttgtgtttgtatatatatatatcaaaaaattttaacttaatatgtgacaagcaactgtatatgctatatttcacattttgattcacaagagtacttaaccatgaaagtgctaagtaaatggtaaagcattatgcaaatgataggcatatcattgttttagcattcaaaattgtattaagaaacattgtaattctcattacacatatgaattctgttctatctttaaatattcaatggctataaaatggctgattatataagacaggcaaaaatatttcagctacttcctttatgtaggattttcccattaacaaagtatctttacaaatgcccaacttagtccctgcatatcatatccaaacaccaaagaatttttcaaatttctccttttaggaaattcagcaatggaaaggcctttgggcaaggtaaagataaaaaaatcacattttcaatatggctttgccttgtaaaactagaaaaattacatcatgagcaaacatttggcaagtgcacctgttcattgaccctggaatgtgatggtccatgatgaataagaatcttcacaatttccacatctcctttccaggcagccaggtgaataggaaaataccctttgttgtctgctacatttgttgatgcctcatactgaagtagtttgagaactatgtccctaaaaaggaaaaaacaacaacaacaaaataggctgagcaagacaaactgtattaaataggtaattttaaaagaatactagatgctgggtgggaatttagagtaatcattcaaggtactaagatataaagttgggtttcaaagtttttgcctactcaacatttggctattttacttacctggaaaaccatcaccccatgccacacacacacacacacacacacacacacacacacacacacacacacagagagagagagagagagaaagagagcgagagcacacattgactaaccaattaaactacttaatagaattcatataagcaaaacttaacttatttcattaattagatgagctaagtaaaatgaagaggataccaactcccatttttttttttaaaaaaagagctctttccagatagcccatatctgagatttagtttgaaggaaaagttgaagttacaagtatattccttgtttacacacacacaaaaagttatcataataccaaggaggcatttataaaatttacacatcattcctacagataattggaataagagatttaaggggtatgtaaaagagaaagaaagtgcagtatgtaagggacccttgacaagctaactgtagtactagcccagggttaaaaaataataataaaaaaattttaataacttctcagtgatggcacacaacacactttgagtattccttgttcctacttctgtattccttcacctttcttctccaagcataaaaaattatttcaaaagggaaactcatttaaaagacaagttccaccattaatgcaatttcaacacatattcaatatatcctacctcaaaaattttgaacttaatccccaccaggttttcaaagtaaaaatcctgacctgcattactcaaccttagaaagaattaattaataattattagcataaattatatcaaaatatatgtcaacaatcaaaagcagtaattctaaacaaaactgtattttcatttggatgcatttaagaagcaaattctattaactcactaaatgaaatgctagtcagacacacataaataaaaatatatatataattacaatatataataaagttgtttcttacatacaacaaatcactaatggggagggtgaacataacagatttacatttaaacatttcataaaatcagactctagatgcaagtaacaaatgaaaacatttggaggaaattttaatagaaggaagattagaattttgatagctcacaagaaaaacagatatgatatgatacaaaattatggtaaatggtaaaacatactgtccagaatgtgtcctaaagtcacaacatttgacttaattgctaaatgtaagaaatcatgattttaaaaaaacaagaatatgttgtagaaatatttagaatccaaggagtcctaaattgtctaatgatataatttctgagaaattaagaattaaattttaacatttctctttgaaaaaccagcattattttacgaaatctgaatttagaagacttggatttgtgtcccagctatgcaaactacctgaggctgtgattccggagaaatgataatcacacaccacataatgataattcgatcaacaacagaccatccgcatatataatggttgttcaaaaagattatcatacctcatttttactgtaccttttctatgttttgatatgtttagatacataaatactttctgtatctattgtgttaaaattgcctacagtattcagtacagtaacatactgtgcaggcatgtaactcgggagcaacgggtcataccatgtagcctaggtgtgtgacaggctatatcacttagatttgtgtaagtgcactctatgatgttcacacaatgatgaaatcacgtaattagacatttctcagaatgtatccctgtcattaagaaacacatgactgtacttagtctcattttctttttcttcaggagatactataatgataatgtctactcaaaactggtaatagcattaaataagatcataaaaaagaattcactcaataaatagtaaagcactataccaataatagcacttgtcccaagtaaaaataaaatactttagaagtgaaatgaaatgcttatagaaagtcaccttcgaaaaacagaatcagaaaatcagaaggaaacttaaaggttatccagttcacacgcttctccccatttccctgccaagcaagggttgttatatagggtcttccattctgacataaataaatacataacttcagtgaggtaatgagaattcaatacctatgaataacaaaagcagataaggaaagatctgaagtcccaactctctactatttacaaacctggttaccttgaggaaattaagtaacctctgtctctctttcagatattgtgaaaatagaatttagagattacatcttggtgctagtttcaaacagttatggtgtgaatcaaatgagaaacagatgtaattgtaaaattatatatacaatcaaaagttgttctcaaggcagattgttgcaatgttaaacaattccagtgattgctttttaaataaaatatttcagcatttaaaaggcaaaataatagcaaaagaagttagtcaaattaaatacctggatctaaaatgtagaatttagcctactacaaaatagacttctccaagttactgtcaaagacaactgtgagaagagaaaaatttcatttcttaatacctaaggaaataaaaaatatattctgaaacaacttctcctataaagcatttcctttcaaggggtaaagacgaaaaaaagattgatgggatcatcaattctatttccttttactcttgctccaatcacttagaatttcatttgttctttggctcaaattttactgacattttctaataatgtaagtgatatacattcattcttcatttatcaggaagatttatgacaagtgaaaaaacgtctattttgaaaactgacttactaatcatttgtattttctagtattaccaccatctaatatctaaatcagaaaagaataatctgtaagtttgtaaaattgcctttggaaaacactaagatcctaactacacattatttacacattatttttaagttttgaaaaatgtatttattttaataaataaatattttgttaaatgtgcttatttttttcttttttaattttatttcaatagtttttgggacacaggtggtttttggttccatggatgggtaacactttagtggtaaattctgagattttagtgcactcatcatccaagtagtgcacaatgtttccagcgtgttgtgttttatccttcactcccctccaaacctccctccaccagtccccacagtccattatatcactctgtatgttttggcatccacatagcttagctcccacttagaagtgagaacgcatggtatttggttttccattccctagtcacttcacttagaataacggcttccagttccatccaagttgccacaaaagacattatttccttctttttatggctgagtagtattccatggtgtatatatataccacattttatttatccactcattggcacttaggttggttccatatccttgcaaatgcaaattgtgctactatacacatgtgtgcatgtgtctttttcatataatgacttcttttccttcgggtagatacccagtagtgggactgacggatctaatgatagatctgcttttagttctttaaggaatctccatactgttttctatagcagttgtgctaagttacagtcccaccagcagcgtaaaagtgttcccttttcaccacattcccaccaacttctattgttttctttttttactttttaattatggccattcttgcaggagtaaagtggtagctcattgtggttttaatttttatttccctgatgattagtgacgttgagcactgtttcacatgtttgttggctgtctgcatatcttcttttgagaaatgtctattcatcccctttgcctactttttgatgggattatttgttttttttcttgcttatttgtttaagttctttgtagattctggatactagccctaatttgcaaatattttctcccactctgtgggttgtctgtttactctgctgattatttcttttgctgtgcagaagctttttggtttaattaggtcccatttatttattttcgtttttgtttaaatgtgcttattttaaaattaaaattaaaattaaaatttattttcaaatttttgtttaaatcgagctttacatcttattcaaagataccagctaatgaattggttgagctcagatttctagtgttaaaacatatttgtgaaatataaagttgtatccctgatcaaataagtatctgtcagttttactaagttataagtagaataaagtgttaatcagcaaattatgattaatcattcttatgatatatccatatatatccaaagtaatatgaactaaataggccattttcatccaggctcattagaacaatttaaatttcatatataatatctaaattagaagagcagttaatatagtgtagtaccaacttagtatttttattgatacataatagttgtatatattttggggatgcatgtaatatttttatatatgcatacaatgtgtaatgactaaatcaggataattggggtatccattacctcaaaggtttatcttttttttgtgttgggaacatcacaattcctctcttctagctattttgaactatacaatattggtaactttagtcagtctactgtactatcaaacactagatcttattccttctaactgtatttttgtattttaatcaaatctcttctcccccccccctttccttcaaagcctcctataaataccaattaactttctacttccatgagatccccttttttttagctcccacatatgagtgagagcatgtgatgtctgtcttcctgtgcctggctcatttcactttacaaaatgatctcatgtccatccatgttgctgcaagtgacaggatttcattcttttttatggttgaataatattctattgtgtatatgtgccacatttactttatctgttcacttgttaataagtaggttgatcccatatcttagctattgggaatagtgctgcaataaactggggaatgcagatatcactttgataccctgatttcctttttttttttggatatgtacccagcaggggcattgtgaaatcatatagtaattctatttttagttttttaaggaacctccatacttgtcgtccattgtcattgtactaatttacattcccatcaatggtgtacctgcattccccttcctctgcatccttgccagtagctattatatttgtcttttcagtaaaaatcgttttaactgaggtgagatgatactgtgattttgatttgcatttccctgatgattagtgaggttaagcattttttcatatgcctgttggtcatttgtaagtcttctttcgagaaatgtctataatcgtttgcccatttttaatgaaattatttggttttttgctattgggttttttagttccttatatgttctggctattaatctgttgctagatagatagtctgcaaatatttttttcccattctgtcagttgttgaagctgggaaaactggataaccatattcagcagaatgaaactagacctctgtgtctcaacaaatacaaaaattcagtgaaaatggattaaatatttacatctaagacctaaaactatgaaactagtaggggaaaacacctcaggacattggtctggacaaataatatttgggtaagacctcaaaaacataggcaacaaatgcaaaaatagacaaatgggattacatcaagcttaaaagcttctacacagtatttctttaaatattatttaggttgagccttatagcttactttaaggtatccacaaaggaacacatcgcctgtgcttggtcaactggcatgaaatattcagtcattgattgatgagcatttgggttggttccacgattttgcagctgtgaattctgctgctataaacatgcgtgttcaagtacatttactaatgtaaccaaatatcacctggaccacaataacttattgaaaaattaatgttaaaaaattcattgggactgtgaaaaaagaaatattaagttacattgctaatcaatatctgtaaaatagcaagcagcaaaataatccctatgtcttaaatgtaaagtagcattttctgatatccagcatttgacaaataacaaatactctaaaatcctaaagcaaatgtggttgacaagaaaatagaaaaaatattttggaaaatggaaatagaaatggaaaaatactttccatttcccaaaaacaaagtaaaacatcaaattaaatttaataatatccaatgtaaatagctgcaatattttgcagctttaagctaatacatgtaagttcagttaaaaacaggaattctagaagtattgacttttgctgctatatttaattcacatccattttctgaaagatataaatacacatctgattaataaaaaatgtatttcggtaagttcagcatatgctctgagcaaaattaaataaattgggaagagtcaaccttcaaatttctttgcctcaacagcaagattccctgtaattaaatcacaaccaaagatgtttatttcataccatcctctcttgcttgttgattgagtccaaagaatttcaaaataaatgcaaatcatcttcatatggatgcagaattaacatctaatgaaactctcaaatttaataaggtccttttgatttcagattttcttgacacttttacttctctttaatgggaataaagttgcagatgtgttcaagatggtcaaaagatttcaggacaatacgtcccattttctaactgaagtttctttacatgttgaattcactctcatagatttctagattacagagtgaataaaggcaaattttaagtagtctgtatccttatccaggaaaaaaagcaagatgactaaagatgtttctagttattcaaagagcaacttcagagaccagattatacaatttttagaggaggtatgcctcttttattagaaaacctaagaaagatcaaatcatacagatagcttattatatggattctagatccaatttgatacgcaatctggattacagataatgagatctagcatgcattaaatactttaaaaggtagaagaatagaaaatatcttatgtgtatataaaacaatatacatatttcagaaatacaataacgatctgctgatatttttcaaaacagcatgcaagtgtcacaatataccaaatatagtttaataacattaaacttaagaagaaaataaggaactatttgttaagtagagaagaaaaattgaattgaaatatgagtatacaggtttaatataacctcacagggaaagataagattattactaaaaataatggatgaaaagaagagaggagaaaagtcagaaagaaggaaaagtaaaggaaaaaggaatgaggggactaaggaaagcagaggagaacaagaaaaaaagggatgagaagaagtgggaggcagggaaggaaggtagagaggaaggcaggtagtcaggccagccaattgcttttcagaggagaattaagggatttgaatttgcagtagaaatacatgtgacaatgaatcctccatattttaaaaagagaaaaagatacaaagaaatagctctctactctatctatggaaataatttataatacttgcagtaaattttgttttattaaccatgattttttcctatcatttgatggtaataattttctaatctgtgattacaaataacccaagaaatcaccagtagagtacattttccattgtgtcctgatctggctaattgaagatgaatatgaaataatgcatttcaggtacaaaatgctgcttcatttgtggattaactagcattgataaacaatggctcccaatgaaaatgtacaaaattggggaaactggtttaattttcagtatgaaggctttagattttatgttgggggtagggggacagtttgtgttcaaagcaaaagaataaactatatgatcccgaaacattactgctggctttatgattctatgaactttagcctaccaattataatgtttatggaaaaaatctagagcagatggatacaacaacagcgacaaacatggaaatgatgtgtttctgtgcagactgctaaggcttgcttgggaagaatacaatataatcattgttagttacctctgctaagtgagaatgcaaataaaagaaataaccttcttctctggctctgagatacagtctatgacattattttctccctcaaatatcttttaagccaatattaaaattagcattccatgtaaacatatgacaaatgattatgggaggcaggccagaaatatataatgtgacagagaagagccagggagagtttaacaacaaaggggagataatgcagagtactggtaaaagcatagacttagaaccagaacacttaagctctagacacaaccccactttaatatctatgtggccattaagtcacttaactaaatgggcattgtttctccatctataaaatgagggagctgaggggtgtcaggtagaaaaagtgatctctaactgtacaagttcatagattatttaaacttgcaaaatcaagaaacatacactctatatgaaattcccaatttcagaactgtagcatcatagtgcataactgagccataaataataccaacacagtgtatcattcaatgttatcattgtaagaaacaatggagaatatcaagccaatctattcaagctattgaactgaggcctacagatgttaagtaaatggttcaaggtcacacaactagcagagatggggagatggggttagaatcttcctgctttttccaatgcctataggatgacactgaaaattaaaaagaaaagataaatgagatctttcagacaaaagcacagacatataattcccacagactatctgtaattaaagggatctttaaaaatagctaatcaaattatctgtttgtgagaatcttaatgattgctattcaatttgcttaaattatctttattttctaaatcaccaaaaaaaaaaaaaattatgccatgggccatagaaaaacatatctcaacagttagaacttcatagactgtcatgtataaatcagcatttactaaatacttcactgaaaatgaaggagggatatgaatgctaatccattttgggacaatattactttaagaagtgcttacctaccaatgccaatctgagaaagaacaagaaaagtagtatgcctcaaatgaaaggtcaggcccaagatatcctgcccattagatgtaatagagtttatcttcccaattagaactaaaaaatatgatagtagcctgaatccataattcagatagccaagaagccatcaggattatattacttgggctgatttgtctttgttcctggtgactcaggtaaaaaaagaataacaacattctcctttaaaatatttagatatctggacatactttccattctataaaggaagagaaaaaattagaagatatggcaaaatatttctaaatgagatgatataagacaatatagaataggaactgaataaaaataaatacaatttgggaattccaattctaaaaatctaaataatgaaacaaagtttataatagtttatgtaactcaaatgattctctaaacaggctgatggcattaaatttatacattttaagagaaaaatgtcagtgatcaataatgacaaaaaaaatgtcttgcattaagagctttatgaccaccaaacctaagattaagtatgaagaagacccttgagtcaccattcacagaataaaagaaatgttaggtgaaaaaacaaaaggtaactaccatttctactttttaaaaaataatttcaacttttattttagattcaggggacacatgtgcaacttttattttagattcaggggatatattgtatgatgctgaggtttgggatacaatttatcccatcaccttgatactgaggatagtacccaatagtttttcaaccctccctaccccctctagtggtctccagtttctatcattgccatctttatgtccacaagtagccagtattaagttcccacttataagtgagaacatgcagtatttgatttgctgttcttccattaattcacttagaataatagcttctagctgcatctgttgttgcaaaggacacaatttcattcttttcatagctgcatagtattccatggtgcatatgtactacattttctttatccaatccaccactgattggcacttcaattgattccatgtctttgctattgtgaatagtgctgcaatgagcatgcaggtgcttgtgtctttttgatagaacaatttactttcttttggatttataccctgtaatgggaatgctgggtagaatggtagttctgttttaagttctttgagaaatctccaaactgctttccacagagactgaactaatttttacattcccaccaacagtgaataagcactctcttcactctataaaagatgccaacatttgtcattttttgactttttaataatagccattctgactggtgtgaaatggtttctctgtggttttgatttgcatttctctgacgattagtgatgttgagcattttttcatacacttgttggccacttgtatatcttcttttaagaagtgtctgttcacgtcttctgagtactttttaatgggattatttggtttttgcttgttgaattctttaaattccttatagattctgaatatttggcctttggtagatgcatagtttatgaatattttctcccattctatagtttgtttattgatagtttctcttgctgtgcagaagtgctttagtttaatgaaattaggtcccacttgtcaattttatctatttatttatttatttttgagacagtcacccaggctggagtgcagtcatgagatctctgctcgctgcaacctctgcctccagggttcaagcgattctcctgcctcagcctcctgagtagctgggattacaggcacatatcatcgtgcccagctaatttttgtaattttagtagagacagggttttgccacattggtcaggctggtctcaaacttctggcctcaagctatccacctgcttcggcctcccaaagtgctgggattacaggcatgagccactgcacctggcctcaatgtttctttctgttgcaattgcttttgaagtctctatcgtgaagtatttgcccagttctatgtccagaatggtgtttccaaggttttcctctaagattcttatagtttgagatcttacatttaaatcttcaatctaccttgagataatttttgtatatggtgaaaggttaaggtccagttccagtcttctgcatatggttatccagctatcctagcactatttattgaagagggagtcctttctccattgcttatttgttatcaattttgttgaataccagatggctataggtgtatggctttatttctgggttctctaacctgtttattggtctatgtgtctgtttttgtaccagtaccatgctgttttagttaatactgtagccttatggaatagtttgaaatctgctatcatgatgcctctggctttgctctttttgcttaggattgctttggctatttgagctctttttttaaattcaaaatgaattttagaatagttttttcctagttctgtgaaaaatgacattagtaatttgataggaatagtacggaatctgtagattgtaactagcacttttaaagcagtaattaccacatctaaaagactaaagtgagggccaggcgtggtagctcacaatcggcactttgggaggccaaggcgggcagatcacgaggtcaggagttgaagaccagcctgatcaacatggtgaaaccccgtctctactaaaaatacaaaaattggccaggcgtggtggtgggcatctgtaatcctagctactcaggaggcagaggcaggagaataacttgaatccaggaggcggaggttgcagtgagccacgattgtgccactgcactccagcctgggcgaaggagtgagactctgtctcaaaaaaaaaaaaaaagtgaaatgaaatgatacagatctgggaaaactaacttggatcattcacacaaagggaaaacagagacgagggggagataaaggaagagggtcattttttttctgtaggggaggacagaacatctgaatcatttggaggactcatcacactttaactctgtcactaaaccattaggatacctagctaaaatactggaaatagagattgttacggctacacactcttgcactctccataacatatactattacattatttgaaacagttttacttattaaaaaaatttagggttggcaaatctaaaactagaaagacaatcatgaatgacaaagataaaacattttagctaaataaggattctgaagtggttcatataagtgaccagggctcagaatagtgggagtcatgctaagtttacactcctagtaaacactcctatgttgggtgaatacaaggagacaccaaaaaaggtaaaggggtgttatcaagtggttttatcccattctctcccccaaagatacacatgactagcatggtcctgtcaatttttccattctcccagtgtgataggttgagtattttagagcatttctttcagcttacactctgcacgcaattatactcagcaacattcctaccaagtctaacttgtcagtgttgtcacctggtccctttccaaattcacctaagcccattggactcacagagacatgagaaaggtatcgtcaagacataattaacttcatcacatgtaactaaatacacacgattccgtccaaataagtggcacttacttatgtccatttaaggctgcgtggtgtaaagcagtgtaacccgaactgtctgtgcagttcacattggggcctcgccagatgctgcaaataaagcacaagcgcagagttaacagtgaagccagatcttgccttgaaaaacaaaaagaaggctggtagccccacagtcagcagcaggttgtagataaaaattttagccatgtggaaaatgattgccatcttctatgaattcccctcagaacatcaacttcatttatttgataaaaggaaactaatagagaatgcaactattaatatcttcagaaattattaacaaatgtgtgtccatggtcgtgcactgaagtttggatccaaaaattccctattactttctatcgttacttaaatattagaagcaactaacattcagctactatattccataccaaagaataaagatttatgagacctgcctcatgcctgttaacacactccttctgaggtgccggtgatttatataagttataagatatttttgcattgtgggaagaatataaagtctttttgctcttcaattgcaaccaggaaaatgtaatcaatatttcatacttgaaaataaaattgaagatttggactgttgtaaaccatgagaagatcctaacaattttgcagtcatcattgattttactatgcaatatattctggagataacatgtaactatataaaagagtctattttttttttgataactacaattaaggaaactctttttaacttttggaaaataaggcactgaaagacacttttccaaaaatagaacaaaaaattgctttatctgatggtcatagtgatatcaaaactatcaaagataaactagttcacacattcacaaaacatttattgtacaccaactgtatgtcacatattgagctaggcactgggagcacaaaatcgtaactcaaggtccttctttacaagaacatagtgtaatggaaaagatagacacacaagctaataattacaaagtggtaagataatcaaggtaccagacagcacacaggcatctctgaaaagagaatgaatagctattccaaacaaggggtcatggcagacttaaactaaggtgggtcaatgaaaatgaatggaatgtgcttatttgacagttaattaaaagaagaattaatgaaacacatggatcaattggaagaaggtgggaaactggaagcagtagtctagagatgactcagactttaggcttacatgactagaaaaaattacaatattaactaagatgtgaaataaaaaaagagcaaaatctgctgcagggaagacaatgcaggatggagagaaaacaatgactcctagtttgcagacgttaaatcttaagtctctgacttacttacattacataggttcaatgcaatccctatcaaaatcccaatggcattctttaggaaattgaaaaaaaattctaaaattcatatgaaaccataaaagaccccaaatagccaaaacaattctgagaaagaaaatcaaagttgtatgccaggctcagtgactcatgcctgtaatcccagcactttgggaggctgaggagggaggttcacttaagctcactagtttgagaccagccttggcaacataacaagactccatgtctgctaaaaataaagaataaaaaaaattagtcaggtgcggtggtgcacacttgtggtcccagctacccaggaggctgaggtagaagggttgcttcagcctgggaggtcgaggctgcagtgaaccataatcatgccactgcactccagcctgggcaacagagcaagaccctgccacccccacaacaaaaaaaagaaagaaagaaaaatggaggcatcacacatccagattccaaattcaggggatatatatacatacaataaaatattattcagccctaaaaaagaattatatctaaacattttctatgacatgaatgacccgggaagacattatgctaagtgaaataagccagacacaaaaagaaaaatattgcctgaaaatatacggaatctgaaaaaaaatcaaatatacagagatagagaacaaaagattggtagggggagtagaacgggggaaataaatatcagaggatacaaagtagcaaatatgtaggatgaacaagtgtagaggtctaaagtacaacatgaagactacaggtaccaaaattgcactgtatacgggatttcagctacgtgagtagattttagctgctcttgccacaaaaacaaaaaataaagggtaactctgtgagaggtggtcatttgtttcactgtagtaaacttttttttactatctatatgtatcccataacatgtgtataccacaaatatacacaataaaatttatttttttaaataccacaatgacatgctactatataactatcagaattgttatctttaaaaaggcttcacaaacctatattgacaaggatgtagatcaaccagaattcacacacacactgctaataggcatgcaaaatagtacaaccacttagtgaaacaatttggcagtttcttaaaaagttatatacaaataccacacataacttaccatcaaatcataccatacaaataacatacaaataccatataatccagtcattccactgtaggtatttagcccagagaaatgaaagcatatgtccataaaaagacttgtacatataatattaataacagctctataggtaatagcctaaaacagagacaacccaaatgtccattagctggtaaacagataaattgtgatatatccatacaatggaaataaaaagaattaaatactcagaaacaaaaggaattaaatactacgacattggttgaaaatctaaatcaattagattttctcaggaagaacagcagaatggctgcccttcaatctccccagcagaaagggagacattctctggcacagataaaatgcatgatctctggactagacccctgattggtagccttcatcaacttctgtgatgtaaatacttcaacttaacgcagtgataggaagagatgctaacaactgcacttcacaagcagacacaagccaatccagcacaccattcaaaggcctacaaccaacaagtcccaacactatgaactcagagcttcccatgagtttttgaaaacctccactctcaaatatgaacaaataaccaaagacatccaatcacttgaggaaagcctttactactaaagaaaccaaaacaaaaaattaggaacaaactacagaaaaaaaagaaacttagagaaaatttagactatgcatggagaagaaattttcaaaaacagttatcattaatatcatctcaatattagaaaagataatgaatgtaagaacaatgaaataaaaaagaaaatcagagataaaatcagtagaagaattaaaaataaagctgataaggccaggcatggtggttctcgcctgtaatcccagcactttgaaaggctgaagtgggcagattacctggtcaacatagtgaaactccatctctaccaaaaatacaaaaattagccaggtgtggtggcgcacgcctgtagtcccagctacttgggagggtgaggcaggagaatcgactgaacccaggaggcggaagttgaagtgagtcaagatcgcaccactgcactgcaacctgggtgacagaatgagactctgtctcaaaaataaaaagtaaaaaataaagctcatgaagtatctcagatacttagaaaaaaaaggcaaagatatagacaaatagaagggaaatcataagaaaagtaggacaccgatttagcagttccaatattgaaaaatagaggttcttaaagtcaaaacacagaaaacaggagaatgaaaacaatgaaagacatcattttaaaaattatcagaactgaaggacattaatttaccaaataaaatgtacatgggccagtcgcggtggctcacgcctgtaatcccagcactttaggagaccaaagtgggtggattacccgagtgaggtcaggagtttgagacaagcctggccgacaaggtgaagccttgtctctactaaaaatacaataattaggccgggcgcggtggctcacacctgtaatctcagcactttgggaggctgagtagggcggatcatgaggtcaggagatcgagaccatcctggctaacatggtgaaaccctgtctctactaaaaatacaaaaaaattagccaggcatggtagcgggtgcctgtagtcccagctactcgggaggctgaggcaggagaatggtgtgaacctgggaggcggagcttgcagtaagccgagatcgcaccactgcactccagactgggcgagagcgagactccgtctcaaaaacaaacaaacaaacaaaaaatacaataattagccaagcgtggtggtgcatgcctgtagtcccaactactcaggaggctgaggcaggagaaatgcttgaacctgggaggcagaggttgcagtgaggcgagatcacgccagtgcactccagcctgggcgacagagtgagattcggtctcaaaaaacaaaaacaaaaacaaaaaaggaccaggatagctttgataaaaaataaaaataaaaaaaagacaaagaaataactgaagtgagtccgatacggtcttttaaatttcaattaaacaaacaaaccaaattcctaaaacacccatccagggctattctcttaatttaaatttttcctctttcaactctagttacactaacaagtcttcactattcaggaaacctagaatgaagagaaattattcatacctattacttctacttcaatctgcaatcttcaattattaatggacactctccaagttctaagtccaagaaaatacaagtccaagaatcaaacaaaataatgaataagatatcatctcttcctccaaagagctgacaatctaatagagaaaaatatatacagataaattacaatataggcagtgaccatagttcctacagcacagaaaacacctaataattgtttgttatcaatcttcttgttcttattaaataaatgctacaatagaaaaatctttaactccctaaattaatacatctgttcaacaaaaatctctatggaatattttacggaaaactcaactaaaagttctaaatttgatttagaagaatttacgggaaaaaaaattgtgaaacaagaagtaataatgggatctacatactaccaattatgaaagcatatcataaaacaataccaaaaaatgttagtctagcaccagaatagagagctcaatgaatataagagaagccctagaaacaaaccagtcatacatataggaataaagctgacatctgaaagaagcaaaaaaaaaaaaaaaggaaaacatcattcaataaatagtcccgagaaatatgttttaattaatgggaaggaaaaaacaatttcaattccctaccccataccatttagcaaaatttaatccacatgatttgttcttgacttctcaaacctcattcctaccctctttttctcacacaccctgttcaaaccacacaggcctccttaaaaatataagtatgcttgcaccttatgactgttgcatttgaaattctctctgcctagaaagttttttcctcaatcatatggctcaatctttctgctcaaatgtcatctcttcggaaactctctccctaattattcagtcaaaaatagcaccctatcatcattctctttcctcttagttatgggacttatcaccatctggcattatattatttatttatatgcttactgtctgtctccccactagaatgaaagctccaccacactatctttgggtcttaaaacagtgactggaatattgtaggtgaccagtaaatatttgttaaatgaaatataaaaatgttgagtacatatatgaaaaatgtcaacctcactggcaatcaaagaaagcaaaaaaaaaaaaaaccaaacccataccattatatatttctttatcaaattgggaaaaaagtcaataatattcagtaatggttagcatgcagagcttataataagctggtggtgaaaatgtaaattggtacaatttttctggaaggcaatttgacattacatgtttaaaagctttcatagtgtgcaaatgtgttacctagaaattctccttaagaggaattattttaagaaattaattaatagtttgtacaaatatttagctataaaaatatttatcacagagtgagggtagtaaaaattatggattttgatatataatgccacttagaatagttattctctctttgctcttgtcagctagatttctaacactgcctgcctccagagcttagtactcatctttctctctagctttcttatatgagacccacagcatcagtgtcttatatggctccagtagcatatggcttgagctcctactgatcagggttttttttttttagcttatgtgaacctccctgggaggagaaagtctaccaacagagtagccagggatcctagagaggacgcaattcttcttagttttatacaatggctcaatatatgtgacagataaacagatatcactattctttaacataaaataaaaatctcacaacaaaatggaaaaacaggatattaacaggcaattcacagaaaaggaaatgtgaatggctaataaatatttgaaaatataattaacctcactgtggctagcaaagagcaaaataaaacagtggctgcctacttttctaccatcagatgggcacaaatttttaaagaaataattgataacaatcaatggaggcaaatatgtgaagaaatagtcactctcacagaatattcattgaagtgtaaattgctacaacattcttggaaagtaacatggcaatacataatcaaatttcaaatatgaatactcttagacccaacaactccacttttcaggattgatatctatgaaataaaaatattcatatgaagactgcagacacaaaaatatacactgtagaattttaatagtataaaagagaaagggtctggaatggtggctcatgcctattatctcagcactttgggtggctgaggcgggcggatcacctgaggtcaggagatcgagaccagcctgtccaacatggtgaaactctgtgtctactaaaaataccaaaaattagccaggggtagcggcgggtgcttgtaatcccagcactttgggaggccggggcaggtggattacttgaggtcaggagttcgaaaccagcctggccaacatggcaaaaaaaacactttactcaaaatacaaaaattagccaggcatggtggtgcatgcctgtaatcccagctactcaggaggctgaggcacaagaatcacttgaacccaggaggcagaggttgcagtgagccgagatcaggccactgtactccagcctggatgacagagagagactccatctttaaaaaaaaaagagagagagagagagagaaagctcataaatgcccagcaaaaaaaaaataaaaaattaattagtccaatagctgagaatggggcaaaaaaggaaaagttaattaggattcattcacactatgaaatgttatgcaactattaaaataaataactttgatctgaatgtattgactttgaaagtcagccaaaacatataaagtgaaaaacgtaaattgcagaatattgtgtgtgtctggagcattccaaatgctttatatgcattagcttatttatagccacacgactataagaaagttactattactattcccattgtatagatgaaaaatatttgcaataacatagaaaaatacatgcaaaaatacattattcattctgtgaatagtctgaatgttgaaattatcatgaatttctttaaggaaaagaaaagacaataaactacaaaggaagaaagataggtttgctccagattacgaagaacctcataatatattgaaaagcttggattttattctgcagcaacttggaactaaatggctttcagaaagataagtatgttcctcacatgatcagtcagtgttttagaataagagctcttgtaacaggtggaaggtaaacagagtgagagtcaggttaattgttttacagaccaggggagaaacaaagcaatttgaacaaatgcagatatagtggtagagagagagagggtgagaaaattcaaattgatatgtctaaaataaaacctatgggagatggtatccatatgaatagaataagaacaagagaatggctgaggtttcaaccatgaacgaaatgcatcaatgatgagatatctccactagaaaaagctgcaagggcagtagtatcttctggcaggagccaagtttcagttaaaactgattagaacactaggttgcttggagtacctcaggcaaaaaatggaaaagaaataggaaaatactgcaaattaactgtcatacattttttaaatttctgcatgttattagaccttacaaatattttgtaagagaagatatttataactaaaataagattcagggcctatagatttcaattacctataccaactcagttccccattatacaaaaattaattataatacacacatttttaataactccattgaatgtcgccttctcctagcaaaatggatatggatacatcttttttaaacaaggaggtttagaatggaaagttagcatatatctaaatatattcaactgcacctattgacagagcctctaggcacatatccacatatccatagaacatccaccgacacatctgaaacaccataaataagccagacccaaaccctccaactaaaaatttaatttaaaaaagaaaccttgatttctaaaaggttctgcttcattccaactttttatattgccttgccccctttactcaggcataatcttcaaatttagaaagagggcctagattaaaaacttgattaacttaagcttgtttcataaaatgcaagagtttctagacacatttaagaaatgtcttgaaaaagtataaaatgcttattacatatttattccaaaaaaagcaatttatagatccttggtcttagtctaatacacacccaaatcccatttcttatgcctacttgtcaatatcttaaattctgtatgtgagaattactgcccaaaatgaatgttctcagacaatatggggttgccaattaccaaaaatttaatttcctttgttatattatttgcactaatgtaacaaatcagattagtagattttagaataaatataaacaaaatagttttctaccaaactttcaaataaccaggacattcattagtcagaatattctattatctaagctttcacatattaaataagattattcttaaaccataagcctgagtttcttaggccaatatccatatgtacagcaaataagatttgaagcacaactactccacaaattgatcattattataccttccatcagtctatggggaaaatctatcagaaataacataaaactgtttcagtttttattgattcctatctgacccctgacacatgagatcacgccgaggcatcagatatggaaattcatacagaatgtgcatttaatgcctcaggcagggtcagagtatgtaggaatggtcttctgacagatcatatcatttcaagcaatgcaaaataaaccttattctcaatctgtgtcttaatagtttacttccatttttggatgaactggacatatgtacatatgctactgattactacaagtgaagttctcatcagtttagtgatggcacaattttattatcatgggctacaagtgtcccacatgggtcaaatgggtctatatcagcactgtcctttagaaatacaaggtgaggactgggcatggtggctcacacctgtaatcgcagcacttttggaggccaagacaggtggatcacttgagcccaggagtttgagatcagcctgggcaacaaggtgaaaccccatctctacaaaaaaaaaaaaaaaaaaacacaaaaagaaaaattagccaggcatggtggcatgcatctgtagtcccagctattcgggaagctgaggtgaggattgcttgagcctaggaggtggaggttgcagtgagctgacactgtgccactgcactccagcctggacaacagagcaagacccagtctcaaaaaataaaaagaaaaaaatatataatgtgagccatatatgtgaatttaaattttctagtagccacattaaaaagatgtgaaattagtttgaatatattttatttaacctagtatatcaaaaacattatttcaacatataatcaatataaaaagtattgagatgtttcacattcttttttgtactgttttcaatattggtgtttattttacacttatagcacatcacaattaggactagccacatttcaaatgcttaatatcctgatgtggacagtggctactatattgcacagcacagggcatttctatataattattccaaggggaaaaaagaaaattaactctaataatatgaaaaagctttctagtataaggaagagtagctaacggatgctggacttaatacctagaagatgggttgatctgtgttacaaaccaccatagcacacgtttacctatgtaacaaaactgcacatcctgcacatgtatcccagaacttaaaatattaataaaagttgatgaaaaataaataataaaaaagtattgtcacattggaacccacatactatcccatatgagtttattgaatgaatatttactgaaatgtgcaaaaccatctaagtaagatagatatacactataaagcttaaaaatgcagagaacaactatgaactggccttctgtgaagaatgagaacaagaatcagcaaactgtagaccatgagccacatccagtccactgtttgtttttgtaaataaagtttcatcgaaacacatacagacacatacacacacacacgcacaaaagctttctaaaaataactgcaaacgttggctttgtagtaaatacatgtctatttgagtcacaaacaatttcttaaagatatcttgcctttggagcaaaaataaataatagatctagtatacagtcatatcctagactgtaatgcacaattttacaaaaagcacatcaggagcatcatagtcaaaatcgtactaactaaacattttctgatgaataatgtgcaccttgaattacttgatgcaattctcaatacatgtatttttaccagcaaatgcgaattgaatgactatgagcaaaagtaactccttgagttataatcacacatataatacaattatgacctctcttcaatatatacagtatgtgccacaagatggaattttagaatatgaaaagaatttgtaaccacaccgagccataaacacagagtcaagagacatgagaggaaaactagagcatctattttaacctagttttaacttcatcacttgttctaaaagtgtaaaacattcctcccagcccatattttctcttctctgcatagatataattcctggaaaataaaccagcagacaaggcagattaatctctcattgtcacacgaacactgattttggtggcaattgtttttcctatcctcacattctcttcataggtaacaataattccagggtactatggtaggaaaaaataatggtacccccaagatgtatacgtcttaatctctggaacgtgtgcatattttgtattacacagcaagggagaattaaggttgcagatagacttacattgctaatcagctggctttatcccggattacccaggtgggccccatgtaattacaagtggagaagagggaaatggaagagtcagaatcaaaaagacggcacagtcaaaaagactcaactggccattgttggctctaaagatggaagagggtcatgaacctagaaacgtaagcagcctctagtagctggaaaaggcaagaaaacagattttcctagagccttcaggaaagaatgcagccctgcccacaccttgattttagcccagtgagaaccacagacctccaggactataggataacagatttgtgttattctaagccactacatttgtggtaacttgctacagcagcaatgggaaactaatacaggtgtgcttattgtaattaacacacccgaaatatgagacgttcagacctttccaaatacttgggaatttaaggtagcatgagaaagagagcatgaacaaaacattgactgcggacttgctacatactagaaactatgcaaaatgctttgtattgattacctaagttaatcttcataacaaccatgtgagacgggggcttttataacccctggatttttaaatgaagaactgaagagcagaaaagtaatttatcaaagatcacacagctagttcacattgcaggcaagatttggaaccaggctgcctgattccagagccaatgacattaaccactacattatacttcagtctcattgtttttatttacctttgattataataaagtggagacatttttacttgtataaatataaggggtccaagtgcagttttgttacagggatacattgcatagtggtgaattctgggcttttagtgtaatcatcacccaaataattacattgtaccttttaagtaacttttaatccctcaccgcccaaccccaaccctcccacctttcctagcctccaatgtctatcattccatcctctatgtccatgtgtacatattatttagctcccatttataagtgagaacatgtggtatttgactttctaagttctttcacttaagataatggcctccagctccatccaagttgccaaagacattatttcattctcttttacagctgtatagtatcccattgtgtatgtgcatatcacattttcttcatccaatcatctgttgatggacacttagattgattccatatctttgctattgtcaatagtgcaataaacatacaagtgcaagtatctttttgctacaattatttattttcatttggatagatacccagtcgtgggattcctggattaaatggtaattctttgagatatttccatgaagttttccaaagaggttatactaacttatattcccaccaatggtgtataagcattcctagaccttttatgtttcatgaccaatttcattttttctatgagtagcttgtttatattctttgcccagtttttgtattgagtttttcattatttttactgattttcatcattcttactgatttgaagaagccattttatatttatagatattaaccctttctaatgttgaaaatatttcccttatttcatctttcagccgaacttatggtgtactttgcctggccataatgtttactaaatcattctatctttctttaaatttattgtttctagccttggtaccattgaaagaaaggtcttcctgattacaagatgataacaatattctctagtatttcttcctatttctttttttgatgaaattttttaatttctctctattatgggtatatgatatgaggtatttcccaatggaataaactaattcaataccactttaaaataattaattgccatctaattaccccagtgaaatgcttcctttctcatatattatttttctgtacctgtatttcaaatctgtattttgactgttttgttacattcatctatcttctccaaagactaatattacattatttaatttctatagctttatagcatattttaatagctaaaaatagatctcttctgatatatatattcttaactgtttttatcatgggtttattcatctgtataatagatggtatagtcagaccaggcacagtagcatgtgcctatagtcccagttcctcagggggctgaggcaggaggatcacttgagcgtaggagtttcagtccagcctgggcaatacagcaatacctcatctttaaaataaaaaataataagtatagtcaaattgtcaaatttaaaaaaaagttttggctgtaattgcattaaacttatagaaaaagtaggaagaaatgagatctttgcaattctgtatttttccagctgaatctgatttccatctctacagctttggtaacagtcttaggcaaggtacttcacttcattagacctgagtttccccataggtaaaacccaaggataatcacagtaataacctcactgtattgtgagaagattaaagaaaaaatataagtattaaatatactacgcaatccacagaaggtacttattaaatgttatttaattggtctaacctttttatattttctttatagaactcttaaaaatattttaaaattattttctttaacatacttacatagtgaatactatgtgccagatatcattctaaatgttttctaaatattaactcaataaatcctcatagcaacgctatcaaatgagtactataattactacacttttcagattaaataactaaggtacagagtagtgaagtaccttggttcaggtcacatggcccctaccaggtgaagcagggattcaaaccacagcatgcctttaatcattatctattgccttgttattttaattcctaagtaatttagttctttattactattccacatgaagtcttatttttcatgtcttttaattactgctgctagttagaacactgtgtttttcaaattcattcactcattcaaaaaatagctattgagtatccactatatacaggcactgttctcattgttctagtcactgacaacacagcagttggagaaggctgtacagaaaaaagacaaaaattcctgccctcatggtctttacattctgatttagttagacaaacaatatacaaatgaatatataaatatatgaagcaagaagtggtatcaagaaaggcaagaggaacagagtgctgttttatgcagcatagtcgaggaagcctctgggataatagggcaactttggaagaacattttaggaagaaatgggcttaatgctgaggaacagccaggacagcagtgtggctggaatagggtaagcaaggaagagagcacagaaaagtgggtcagagatgtgtggctggatcatatagagccttgtggccattctgactttggccttgactgatatggaaagccatcggagagttttgaatggagaaatgacatgatctgacttgtattctgctgctctgctaagaatagtctgaaggggaaagggtagaagcaaggagatcagttaggaaattactatagtaatgcaggaaaagatgatgacggcttagagcaaaggggtagcatcatgtagagggaaaaaatgcttggattatgcatttaaaggtaaaggaaacagaatttgctgacaaattgtgacgtgcaaagaaaagaaacaggaaggactgcgagatttctgtcatgagcaactagaaaattggaattgccatttattaatttggataagtttgcagaagaggttctctattatttttaggtataataatcatgtatctcttcctttataatattcattccattttttctccttacacaaactgcattggctagaaccactaaaataataagaagataatctttgtcttgttgatgaatttaacggcatgcctggtagggcaccaccatttagtatgatgcttgctactggattctcatggataccttttcagcatattaaggaaacttttattccctcagtaaagaacaaaaaggtggaatagcataatggataaaagcacggactcaggattcaaactgtctggactaaaatgctgatcccctccctaactgcaccaccttgggaaaattacctaactactccgtgcctcagttctctcatctataaaatgaatataccagtaatagctagctcatagggttactgtaaagattaaattagatgtaaagtgctagcacaatgcctgacacataataatcatcctttctgtaggaaaagtttttatctagaatggctcttgtggtttgttaaatttatttaggatatctttcacgatggtcatacagcttttcccttttaatacattaacatatttaatgtcggatgagaagcatctctacactactggaagtaaatttatctacttatggtgtatttttttaatataatcctgaatttgatttgctctttgtaacaggattttgcattcacattcacatgtaaattgtctctggttttcttgtcttttttatttcagttttggaagcaggttacataaactgaagagtttggggccttttttctagtttccagaataattcaaccaacatagaaattgattatgttaattgaatatttgaaagagcaaatgtaaaatcatctaggattggcacttttgtggagtaaacccttaataaaattccagtgtcttctatggttactgacttactaatatagtcgactttttcttacattaattctgtcatttacatttctctaggaaataagttctttccatttaggctttctaatttattgactagaaatcatacatatttttaaatcggttgttattgtccatatttacagttctatcaccattgtaattcccagtgttctgtattatttttctctccttggttagtctaggtggggctagtttatcagcatattcagagatttagttagctttatttttatcaaatgtctattggatatgttatttattcattgtttatttactttttaattaactactctctgttcttaactataagaattcagttacctatttcacatttgagttgaatgcttcactcatttaattttattctttcttattcaaaggtaaaagcattataggctgtgacatttctacggaggttttgcccacatgacttaggttttgacgagttatttttcatttcaattattatatacacagcctgtaattcagtttttgtgtcctttttactctgaaaattatagttgttttttaaatttatcaatgcttagaatcattatatgtcttgctctatttctagtgttaccacattatagtcagaaaagaattcttcaacttctaataatttatttagaatttttttgaaaactagtatgtagtttttgttatgttacatgtgacaaaagttctttgattaaccaaattttagctggcctcctaaaacttctcctaggcccatctgtgtacttccttgtaaaatagcaagagctctgctcagtcagtttagcaagaacctccacccttgagatcttatcagattcctcatcctccaccatccctcaggtgatacctggtcaccatggcctgtcttcagctagacttttcgaagttggtttagccaaaaaccctcttacccatgtttcctcttggtaattttccatccactgacccctgccctgttccccggctatgaatttccacttgcccatgctatatttggcactgaccccaatctctctcccccactgcaaaatcccattgcagtggtccctatacctgtgatagtcctgaatattgtcttccttaccttgctttaacaagcatcattgaataatttttgttaatgcatgagcattgaaaagtatattctattttttagggagagatgtgtacttttcaagcttattaattgcataattcaaaccatcaataactatttagttcgtctacttcattcgcaaatttttggaaatgttaccatacacagtatatcactgtgattgaattattaccaaattttctttgtatttctaagtttgcttcatgtgttttgttgctgtagtttcttcagtttgtttgtttgtattaaggcttttttccaacttttaggttcaagggtagatatgcataacgtgcaggcttgttacacagggaaatgtgttcctacatcatttctgtcatttatgtttttctaggagataagttatttccatttaggttttctaatttgttgactagaaatcacacatatttttaaatctgttgttatcttctatatttacagctctattaccattgtaattcctaatgttctgtattatttttctctccttggttagcctaggtggggctagctgcacagatcatcccatcacctggctattaagcccagcatccattagctattcttcttgatgctctccctcctctcacccccaaccctccaacaggccctgtatgtgctgtccactccgtgtgtccatgggttctcatcatttgcctcccacttataagtgagaacatgtggtatttgattttctattcctgcattagtttgctgaggataatggcttccagatccatccatgtccctgcaaaggacatgatttttttcctttttatggctgcatagtattccacagtgtatatgtaccatattttctttatctagtctatcattgatgggcatttaggttgattccatgtctttgttttgtgaatgatgctgcaatgaacatacatgtgcatgtatctttataacagaataatatatattcctttaggtatatacccagtaataggattgctgggttgaatggtatttctgtctctaggtctttgagaaatcgccacactgtcttccacaatgttgaactaatttacacccccaccagcagtgtaaaagcattcctttttctccacaacctcgcatctgttgttttttaactttttaataacagtcattcttactggtgtgagatggtatctcatgtcgtttagatttgcatttctctaatgataggtgatgttgagctttttaaaagtttcttggccacatgtatgtcttattttgaaaagtgtctgttcatgtcctttgcccacttcttaatggggttgtttttttcttgtaaatttgttttaagttccttttagatgctggatattaggtgtttgtcagagagtagattgcaagaattttctcccattttgaaggttgtctgttcactctgatgatagtttcttttgctgtgcagaagctgtttaactcgatcctatttgtcaatttttgcttttgtggctattgcttttggaattttcatcatgaagtctttgtccatgcctatgtcctgaatgatattgcctaggttttcttccagggtttttctagttttaggctctacatttaagtctttaatatatcttgagttgatttttgtataaagtataaggaaggggtccagtttcaattttctgcatatagctagccagttctcccagcaccatttattaaatagggaatccttcccccattgcttttgtcaagtctgtcaaagaccagatggttgtaggtgtatgatgttatttctgggttctctattctgttccattggcctgtgtgtctgttttggtaccagtaccatgctgttttggttactatagtcttatagtacagtttgatgtcaggtagcatgatgcctccagctttgttctttttgcttaggattctctttgctatttgggctcttttttggttccttgtgaattttaaaatagttttttctaattctatgaagaatgtcaatggtagtttaataggaatggcattgaatctataaactgctttgggcagtatggccattttcatattaattcttcctttccatgagcatgaaatgtttttccatttgtttgtgtcatctctggtttctttgagcaggggtttgtagttctttttaaagaggtccttcacttcccttgttagctgtattcctaggtattttattctttttgtggcaattgtgaatgtgagttcattcataatttggctctcggcttgcctcttattgctgtataggaatgctaactatttttgcacaatgattttgcatcctgagactgctgaagttacttatcagcttaagaagcttttgggctgagatgtggggttttctacatataggatcacgttatctgcaaacaaagatagattgacttcctctcttcctatttgaatacctttatttctttcttttgccggattgccctggccagaacttccaatacttgaataggagtggtgagagagagcatctttgtcttgtgctggtttccaaggggaattcttccagcttttgctcactcagtataatattggctgtgggtttgtcttatatggctcttattattttgaggtatgttctttcaatacctagtttactgagagtttgtaatatgaagggatgctgaattttagcaaaggccttttctacatctattgagataatcatgtggtttctttacttctgattatgtaatgacttagtttattgatgtgtttatgttgaaccagccttgcatcccagggatgaagctgagttgatcgtggtagataagctttttgatgtgctgctggattcagttttctggtaatttgttgagaatttttgcagtgatgctcatcaaggatattggcctgaagttttctttttttgttgtatctctgccaggttttggtatcacaatgttgctggcctcatagaacgaggtagggaggagtacttccttttcgatttttttggaatagtttcaataggaataacaccaactcttctttgtatctctggtagaattcagatgtgaaactgtgtggtcctgggttttggttggtggctatttattactgcctcaatttcagaacaatattggtctctttaagtttttcagttaagcaaaagaatggcacatcatctttatgaattaaatgttttattattattttaaaaaattgactttgttccatatattgctctttaccttgaattatgccttgttattaatattactacatctgctctccttttgtttaacttaactagtagagttttgcctatccatttattttccttctatttctgtcattttatcttggctttatctcttgaaaatggcctatagctacagtttgcttttttgttttataatctgagcagctttgccttttaattcactaacatttgttattattcctgctgctaaattgtatgtaatgtttttattctcctttcctattcttttccctcctcttctctcttctctgttttcttgatcaagcgttcttcatttctttattcctttctagctatttttccttaacattttattcctaatagtcctttactttttgcaaatatattaaacctacatttcttactgacatcaataattacattgtaactatgtccatctttaacaaaacataacttgcatcttttcccacttttaacccaaggatttttgataaaacaaggtagaattttaatgctatagtgttactatttcctcttttatttcagaaatactttaataattatgttgtatttgacaaccatgttttcaatagcgacttaggtttactaatttcattgctcaccatagtttcttgaatatttaaaaagattatatgagatactgtgatattttgctgccttcaggttaccaaaaggcacagaatttacaaacatagtgccatgaccactaaagtcctatatactggaatatgattcatccaccccagagttgcaagcagtctttaggagatataaagatatgagaaatcttttgagagatatgaaaaaaggattagaactatgatgtggtcacattttgcggaatgcagtctttgtgtagacaggttatctgttctcctcccctcccataggtgtagaagaaaaaaacactcaactgggtttccttcccaaagttcacagaaagaagaaccaagaaaaacttgaagtgtgttgctgggcctcagaaagcaacaccctaaattatgatgttttggcacgctaagtactttgaactgaaggacagtggcagggcctcagaagcaaggtctctctcttttttctttcttttttttttttctttgagacagggtctcatcatgtcacccagtacacagtgcaatggcaatcatggctcactgcattctcaaactcctaggttcaaatgatcctcccacctcatcctcctgagtagctgggacaacaggtgcatgccaccatacttggttggaaatccttctgtccttctgagcttctttctcctgctcccctttcttccccaaggcaggccataaaaaatagaattcctcttccccaaggcaagtcatataaactagaaatattactctaaccttctccgacctttctgtgtacaacctggccatcaagaaattctctaacctactgtctgatagtaggtcataagaccctcattctagaaggagtcctgccctacacccagaaggaacaaatgcctcacagagaggtcaagaagaacctcaactgacaggccttgctgggtttccccactcagtctattaccattaagtcattccctttttgtctaatcacattcctatgtggccgtccattctcatcaaacctaaaaataaaaatgaacagttttcccttgggtctttacttctgaatgctcctgtgacatataaaactttgattaaataaatctgttattcttttttcttgttaacctatctttagttgtaggagtgttgaccctgacccttaagatgggttaggaaaggtatcacacccttctgcccctacagttgctgcatgaaggaataaccgacaaattcagtccatggttgaactttccctttgcttgacctaccccaaagcttaaggcagagtgggagtagaggaagagggacagggaaacattagactgaaatgacaaattgttcctggtgaaaaagaacagtttctagaatgtatggaacatgggtcctgcccagacccagggaagcctgaattggggcagcaaatggtgaatgagactgagagccacagtctggccatcaatcagtgcagcaggaggtaaacaagcaggagaggaagagagcctgaggctgactgcatggtgtgatagcatctatttgtgggaggctattgacaaacctgctttggagtaatgctgaagagaaaagggtcaaaaatactgtgggcagtcacagtgtatgaggcatcagttttcagtttcctccttgtccctcctccctgcaaagtggaagaatgggggccagggacagagggaacaggaaggggaggaaatagagagaaagaacagaccatgtattccctaccattctctaccataccaagttgcttttgcaaagagaaaaagcattaaatgaaatatgagatgaagttttcaagtggacaggaccaacaaagctggaagacttaaagtaccatatatcacgataatgtaaaagaacaactggcacagggatacataaatagatctatggaactgaatagaacccagaaacagaccctaatctatatagtcccttgatttatgacaaggatgacatggaagtgaggcacttcttattaaatgacgctgagtcaatttcatatctatatacaagaaatgaatctcaacccataccctgagccatatataaaaataaattctagacagattacaagcctaaatattaaagggcaaaacaataaaatttctagaagaaaaaaatttaaaggcacacagcccaataaaaaatgagcaacgtcaatggtggattgcatttaaaaaaaaaatgtggtacaatacaccatggaatactacacagccataaaaagaacaaaatcatgtcctttgcaacaatttggatgcagctggaagccactatcataagcaaactaacacagaaacagaaaaccaaataacacatgttctcacttgtaagtggagctaaacactgggtatacatgcacataaagatgggaataatagatactgggaaataaagagggggaaaggatgaagtgagacaagggttgacaaactacctattaggtgctatgctcactacctggatgatggattcattcatatcccaaacctcagaatcatgcaatatatctgcatatgtattccctgaatctaaaataacagttgaaaaaaacaaataagcaaatatttggacagatatttcaaaaagaatattcaaataccaaatatatatatgtgtgtgtgtatacatatatgtatatacacatatacacatagttgttcaacttccttagttgtcaggaaaaatgcaaattactatcacagtgagacaccactacatatccaccagaatgactgaaatcaaagacagatgaaaccaaatgttgctggggatatgaattctcataccctgctagtaaaatataaattggtgcaaacactggaaagttacttagtagtacttattaaaccttcaaatttgcatactctgtgaccagcaattcagaaattcttacctatgttcactaaaaaacatgtacaagcatgtacagcactgttcataatagtgcaaaactgtccatcaatagtagaaagaataaactgtagtacattcacaaagaatactacacagcaatgaaaagcaacaaaactattattactctccacacaaaaatgtgtcttacaaacataaaattgaacaaaagaagtcatatagaaaataacacatactgaatgattccatctgaacaagttgaaaaacgaaaacaggacagtaattacccttctgggggatagtaactagaacagggcacaactggggtttctgagatgctagcaatattctatttcttaatttggattctggatacatagatgtaatgacttcgtgaaaatacattgtgctgtaaacttatgatttacatacctctctgtgggtttatttaaacaaaatgacaaaaactaagtcttaatagctggaatgtgactgttttaataacagaaagtgaaaaattatagaattggatttagatgtcattagggagcatgttattcagcaggaatggagatttcattagataacagtggtaacagaaattggaaaaatacaattgttttatgtttattccttatgatctaagaattttcagtcatttcagttatattaatctttccttttcttgaaattgatgtgattcaaaacatgttatcccaaaatatggtatcttcgcatttgagaaaacagcagaagcaagaaagtctctctctctctctctctctctctctctctctctctcacctactctcccctttcttccctgaagcaggccacaaagcctagctgaccttatttattatttagttattagttatttatttttataaactcttttctcttaaatttaatctcttagtaacttgaaacttccatcctcttgctatagccttcattttatacatacagcttcaaagtaacccaaattctctatcttctaaaccaatttccaatgcacaaaacacatcaataattctaggtttctacaaatatatgatagctatttttgtcttccatttttatccctacaaactagttagatgcattttataatcccaagcagaaataccccaattatgttaagtgactcaagggatagagttaattttgtatgaaaagattaaatttgcttgattgctcttttttagtgaagactatgttaatgtcaagtttaagagtgatagtattttgcttttgacaaagacataagggaaaattcttctcagctagttcagtatactctaaatcagccacaaatataaatcctaactcaagtttctcacaactagaagaaatcagaagaatatgataaaaatcaaagaattcatatcatgaaaatgaaaggtacaagagaaattcaataacatgctcttcctattttttgtttgacttaccataaaaatctgcactaatgggggacatctatgttttcaattctaagcataagttttagatctccataacatgaaaatgaccacagattctgaatgagtagctgctctccaccaccatatttccaagctctagaaactcagtgctagagctaaactgagttgttgctattgttttatttagaccacttgaaaccctgaaaatcatcaaaatgcagaaaatcactatgttggttaggtttcctgtggcaggaatatttaaaacaatttaagaaaactcctaaccagaacatgttcagagaattattaacatttttattcagaagtttagatgccattttctgcctcatactccctcattccctccagttcaactcttcctaattaagttttctggccttgccctacccccacctgatcatcatgataaaactaggacataagtattaatacttattaaagcattacaagtattaatatgtctactgttccatttcatggatctactcctactaatgaaggaggagatactaaaaatctaaataagaaattgcttttaaccttgaaaatttagaacattacattatgatatccttgaggttatttgaggaaaaatattatttagtaaactggaaggagtgaaattttttttctaaaggtgtcacaaagaagcaagtaatattggtaataacaattttaataatgtactatctcttataatgaaagatgatgttggtaacccagacaagctaatgggcatatgtttcacactggggtaatacttcactaccagtcacaggaacaaaaagccttttgcaaaactatgtgacaaaattaactatgcagtatgtatcaaagaatactgtggtggttttcaaactatgctattcagaacccttcagagatttagggtaaagcagagtcacattttgaggtgttctgcttcattcggattgatatcttcattcatttatgcatacaataaatacttattaagctatctattacatgcatgcctgtggttgactagcactttctggtatcacacctgtaatatgatagaaacagtccctgctctcagaaagctcagtctagctaaaaataaacacatcaagcaaataatggtagaagtaattaattaatggtcaaaggtacaaacacaatagaaacatgtatagagtgctataaaagaagtctttggtaagtttccttcaccttacgggttttctcataagattttagctgaataaagggtacatgcttccaagtgaccaaaataatgtaagctaacctgacacttatggtattaattaccaaatctaagctctgatgccctattttattgtgtcactttgattcaaaagaaccatacattcaaacgttaaggtatcttaagaatctctgtataccagatactatgttagaagctttagggctataaatatgcattcacttaagaaaatatttcaaaatattggattgaatatttactatgctaggcactggggattaacatttccatgtaataattagtttccagcatttctcagaaaatgtatgtttttccaaatcccaagaaaaatcagtcaagaaatagagaaaaacaggagaaaaaatggcggataggaggtaggactaacttgcagctcccactcggatgtacagagcagcatgtggagactcacactgtgaacttttgctccaagaactaccataggaacatatcaggaaagccaagagaatgcacagaccctttgaagaaggtggattggcaccgcaggctgtgtgggacagcagaggaactgtaagtctactcgctttctcagctgggaggcttgtagcctgaggcaagttctccactctgctcaacggctgcctgaaaataaactcggttctattgggagggcacagtgtgagtgagactggcctttcaggctgtgagttgcgggggagctgggtgaggcctgtggctgccagctttcctccacttccctggcaacctgtgtgagcagcagaggcagccataatccccctgggaacataactccattggcctgggaaccaaactcctttcccccatagcagccacagcaagccacgcacaaggagtctgagctcatacacgcctatatctgccccaacctggtggtgtttctctacccacactggtagctaaaaaaaaggacaatctcttaggagcgctatggccccacccactcccagaccctagggcaagcttgtatcctacctatactactggagctgatgcgctcttgaaagtgccacctcctggtttttggagggcaaccaacacaaaaccagggcacttaaaaatacaaccaaggacccccatagagtccgctttgctcccctgctacacccacaagagcaggtgctggtattcacagctgagagacttgaaaacagatcacatcacaggactcttcgtagacactccccagtaccagcccagagcctggtagctctgctaggagactagattcagaagagaaataaccctcactgcagtttggctctcaggaatccccatcactaggggaagggggagagcaccacatcaagggagcaccctgtggtacaaaaaaatctgaacagcagccccttagtgtcccagatcctccctctgacgtagcttacccagaaaaacaatcctggtaatatggcaaaacaaagttctttaacacccccaaaagttcacactagctcaccagcaatggatccaaaccaagaagaaatctctgaattgtcagaaaaagaattcagaaggtcaattattaaggtaattaaggaggcaccagagaaaggtgatgtccaactaaaagaaataaaaaaaagatacaggatatgaatggaaaaatctccaatgaaataaatagcataaataaaaaacagtcaaaaacttctgaaaatgaaggacacgcttagagaaatgcaaaatgcaccggaaagaatcagcaacagaattgaacaagtagaaaaaaaaaacttcagagctcaaagacaagttttttgtttgtttgttttgttttgttttgttttgagacggagtctcgctctgtcgcccaggatggtgtgcagtggtgcgatctcggctcatgtgcaagctccgcctcctgggttcacgccattctcctgcctcagcctcccgagtagctgggactacaggtgcccaccaccgcgcccagctaatttttttgtatctttagtagagacggggtttcactgtgttagccaggatggcctcgatctcctgacctcatgatccacccatctcggcctcccaaagtgctgggattacaggtgggagccaccactcccggccaagacaaggtttttgaattaacccaatccaacaaagacagagagaaaagaatttttaaaaaggaacaaagcctccaataattttgggattatgttaaccaaacctacgaataattggtgttcccaaggaagaagagaaatctaaaagtttggaaaacatattagatagaaaaattgagaaaaatttccccagcctttctagagatctagacatctaaatacaggaagctcaaagaacacctgggaaattcatcgcaaaaagatcatcacgtaggtacacagtcctcagtttatctaaagtcaagacaaagaaaagaatcttaagagctgtgaggcaaaagcatcaggtaatctataaaggaaaacctatcagattaacatagatttctcagcagaaaccctataagctagaagagactggggttctatctttagcctccttaatcaaaacaattaacagccaagaattttgcatccagcaaaagtaagcttcataaatgaaggaaagatacagtctctttcagaaaaacaaacactgagagaattcaccactaccaagccagcactaaaagaagtgctaaaaggagctctaaatcttgaaacaaatcctctaaatacaccaaaatagaatctccttaaagcataaatctcacagaacctataaaacaataatacaattgaaaaaaaaacccaggtattcaggcaacaaatagcatgatgaataaaatagtacctcacatctcgatactaacattgaatgtaagtggcctaaatgttccacttaaaagatacagaattgcagaatggataagaattcaacaataaagtatctgctgtcttcaagagactcacctgacacataaggactcacataaacttaaggtgaaggggtagaaaaagatattccatgccaatggacaccaaaagtgaacaggagtaactaatatatattcttatattcaatatatattcttatattgcaacagcagtttaaaaacacaaaaagggacattatatattgataaaagaactagtccaacaggaaaacatcacaatcctaaatatatatgcacctaacactggagatcccaaatttatgaaaccattactactagacctaagaaatgagatagacagcaagtcaataacagtgggaaacttcaacactccactgacagcactagacaaaccattaagacaaaaagtcaacaaataaacaatggccttaaactataccctaaaacaaacggacttaacagatatttacagaacattctatgcaacaactgcaaaatatacattctattcatcagcacatggaacattctccaagataggccatatgatagaccacaaaacaagtctcaacaaatttaagaaaactgaaattatagcaagtactctctcaaaccacagtgaaataaaatggaaaatcaactccaaaaggaaccctcaaaaccatggaaatacatggaaattaaataacctgctcctgaatgatcattgtgtcaacaatgaaatcaagatggaaatttaacagttctttgaactgaatgataacagtgacacaacctatcaaaacctctgggatacagcaaaggcagtgctaagaggaaagttcatagcattaaatacctacatcaaaaagtctaaaggagcacaaatagacaatctaaggtcataccttaaggagctagagaaacaagaagcaaccaaaccaaacccagcagaagaaaggaaataaccaaggtcagagcagaactaaatgaaatggaaacaaaacaaaataaaaaatacaaaagataaatgagacaaaaagctggttctttgaaaagataaataaaattaatagaccattagcaagattaatcaagaagagagaagatccaaataagctaagttagaaatgaaatgggagatattacaactgataccacagaaatacaaaagatcatccaaggctactatgaacacctttatgcacataacatagaaaacctagtggacatggataaattcctggaaatatacagccctcctacattaaaccaagaagtagaaactctgaagagaccaataacaagcagtgagattgaaatgctaatttaaaagttaccaaaaaaaaagtccaggaccaatcagacatttaaagaattggtaccaatactactgacattattccaaaagagagaaaaagagggaatcctccataaatcattctatgaagccactatcaccctaacaccaaaaccagaaaaggaagtaacaaaaaaagaaaactacagaccaataaccctgatgaacacggacacaaaaatctgtaacaaaatactagcaaaccaaatccaaaagcatatcaaaaagataatccaccacaatcaagtgggtttcatacgagggatgcggggacggtttaacatatacaagtaaagaaatgtgacacaacacataaacagaattaaaaacaaaaatcacatgatcatctcaatagacacagaaaaagcatttgacaaattccaacatcactttatgactgaaaccctcaacaaaattggcgtaaaagggacataccttaaagtaatgaaagccatctattacaaacccacagccaacattatactgaacaggaaaatgttgaaagcattactgctaagaactggaacatgacaaggatgcccactctcaacacttctattcaacatagtattggaagtcctagccagagcaatcaaacaagagaaagaaataaaggggatccaaattggtaaagaggaagtcaaactgtcactgtttgctgaagacatgattgtatacctagaaaaccttaagactaatctagaaagctcctagaactggtaaatgaattcagcaaagtttctggatacaaaattaatgtacacaaatcagtagccctgctatacatcaacagtttccaagctgagaatcaaatcaagaactcaagcccttttacaatagctgcaaaaaaaataaaataaaatatttaggaatatatctaaccaaggaggtgaaagacttctacaaggaaaactacaaaacactgctgaaagaaatcatagacaacacaaacaaatggaaacatatcccatggtcatggatgggtagaatcaatattgtgaaaatgaccatacggccaatagcaatctacaaattcagtacaattcccatcaaaataccaccatcattcttcacagaactaaaagaaaatcctaaaattaacgtggaaccaaaaaagagcccacataaccaaagcaggactaagcaaaaagaacatacctggaggcatcacattacccaacctcaaactatactaaaaggcaatagtcaccaaaacaacatagtactggtataaaaataggtatataagccaatggaacagaatagagaacccagaaatacacccaaatacttacagccaactgatcttcaacaaatcaaaccaaaacataaataggagaaaagacaccttattcaacaaatggtgccgggataattgactagccacatgtaggagaatgaaactggatccttgtctctcaccttacacaaaaataagctcaagatggatcaaagacttatatctaacatctgaaaccataaaaattctagaagacacattggaaaaacccttctagacatcagcttaggcaaagctttcatgaccaagaacccaaaagcaaacacaacaaaacaaagacaaatagatgggacttaattaaaccaaaaagcttctgcacagcaaaaaagataatcatcagagaaaagtgacaacccacagagtgggagacaatcttcacaatctatacatccaacaaaggaccaatatccaaaatttacaaggaactcaagcaaatcagcaagaaaaaaacaaataatcccatcaaaaagtgggctaaggacataaacagacaattctcaaaagaagatatacaaatggccaacaaacatacaaaaaaatgctcaacatcactaatgaccagagaaatgcaaatcaataccaccttactcctgcaagaatggccataatcaaaaaatcaaaaaaataatagatggtggtgtggatgtggtaaaaatggaacacttttacactgttggtgggaatgtaaactagtacaagcactatggaaaacagtatggagattccttgaagaactaaaagtagctccaccatttgatccaggagtccaactcctgggtatctacccagagaaaaagaagtcattatacgaaaaagatacttgcacactgatgtttatagcagcacaatttgcagttgcaaaaatatagaattagctcaaatgcccatcagtcaacaagtggataaagaaaatgtggtaaatatatataccacggaatactactcagcaataaaagggaacaaaataatggcattcacagcaacctgaatggagttggagaccattattttaagtgaagtaactcaggaatgaaaaaccagacactatatgttctcattcataagtgggagctaagctatgaggaaacaaaggcctaagaatgatacaatggactttgggaactcggggaaagagggggcgggtgagggatataagactacacactgggtacagcgtacactcctccagtggtgggtgcgccaaaatctcagaaatctccactgaagaacttattcatgcacataaataaataaataataaaagaaatagggaaaaccagaaccagtaaaagtactataattctcttgtgaggattgaagcttaataacatggagacattactggttcaaaggaatatactgatgtaaagttgaaagcaagagcagataatattgacacatggagtagaacactgaagttccagtaaccaaggaaggtgaacataggagagaagttgtcacatttaatcagttagtcttattgtggctgttgcagagttatatgtgagtattcatggcattgcatgctgctaacagtgaagaactcttgcaagtaaaataaacattaacaagtttacacgcataatatactttatgcaaatccactgagtggtgttccaagaaatgacaagttttggaagcaaagtaagcccttacattgacaagtttgacatataattctttgaggtactgttagctttgctaggagatctgaatgttatgtaattcaaatactacccaatcacttttgactggtgttttctagtgtctgaatattcactacaggctacagttctctataactattattaaacttcatatttctcatatattaaacaaaatgttagatatttaaaataatgagcaaagcatataaaaactgttgaaagttttttgttttgtttttgtttttttttttgagacagagtcttgctctgtcacccaggctggagtgcagtggcacaatctcggctcactgcaacctctgcctcccaggttcaagcgattctcctgcctcagcctcctgagtagctgggattagaggtacctgccaccacgcctggctaatttttatatgttttagtagatacagggtttcatcatgttggccaggctggtcttgaactcctgacctcagatgaactgcctaccttggcctcccaaagtgctgggattacaggcatgggccaccgcgcccggccgaaagtatttttaaaacaacttacaatttcaggaattcccagaaattctcaagaattactacttctcatttctgaatcccaaagattaatatttattgggaattgggaaatactacttgagataaaagttgactaagagaacttccctgcctctttgaagtttaggagagagatgaaaacatggaaaccaaaaaaagtattaaaggtgttaagataaaattctatttaggacacagtgaagacacaaaggcaaaagacacagagcaattatgcccacagaggtctggagaaggctttacagcaaagaacatgagatcttgagtggtgtcctaaaaggcaaaaactaccttctagataaaataaagggagatatgagactgctaacaggccatacagagggaagactgctgaggctggggtcatgaaacatcatgggttgttcagcaaacatttagtagtttagggaggaaggtggagtttgatgggagacaggaagaacagaaagggatttaattcagggaagatcttctaatgaaaggaaaagtctcccaagaatcttaagtagttgactgacatgatcagatttatattttttagaaagatccctctggaggacacatggaggatgggttcaaagtgtgtgagactagagattagtactgcaacagttaggtgcatccctaaacaatacaactccatacattgttaaagacccacacatacccaacacactgcagggtagaaacctgtaagaggaattgggaatgaaagtgaatactaagtctaatgggtaaaataacaagattttaaaacagagagtaaggcagtcatgatgcttgttgattgtatcatgaactgaagagtataataaactcaagccactgtagctgaggtacctaggaacaaacaaatgaaaggatggctatatctttcctactgataaattaaactacatttgccccaaggctgcctccatactttgagtcctatgtaaagaactacaacccaaattagtacataaactcaggaaaagctaattagaagtatacttttgtaacaaatatctgagtctcagccaatcacagcagctgagctttagtctatcacaagcagccaactgatcagaccatgttcaaataaggcaaatgcctagctaaaataaatcaggctgttcctgtacctcgcttctgtgttctgtccataaatgcagcttgcccaggtctcagagcagaaccctctgaacctcttctggttctgagggctgcacaattataatgcaaatcattctttgctcaaattaactgttaaatgtaatttgtctaaagtttttcttttaacactattcttttcatataatcacatgaaataagagaagaaaatcaatggtagaaaaattcccttgtacagtaaatcaaattgttaagaagtgtaatttctttaaaaagatatatctagttactctatcactgactctcaaataatctgtagaactttattcattttctaaagagtcttgttaccctcatgatccgtatcaacctgcaattcaaaatatcatagaattgatagaattgttttgtctatcagtaattgtcttcatggttatatttttttcagattatatttgggaaaagctacttattagaggaatatctacgaataataatcagtctttcacaagcccaaaagctctgatatctccctccctcatgatcccattgctgttgatagtgttatgcagattttgtaaacaattaaatctgttcgcatgcaaacaattttggtttaaccatgaacaacaataaagaagttcatatacttcttttatgtaattcacgatctacccatgctccttttaaaagcatactaatatatcctattatgtattccaaagctgttatacgaaagtgaatgttcttttcaaaattctttttgacatgccactggagcagctccagaaaaaaattaacacttttggggaattttattgcatccctttcagtagccaaaaaggaagcgggtggggcgggggtggggggctgaagccaaagattaaaataaatgcataattcatttttaacatggtaggttttctctcattcttcattgtaatagctctagaactaattttactgttaacactgaatttttagaggggtgttgtataaaccattttttacaaagaaggagactaaaaagattttctgctcaccatcagtgcacaaaattgaacaagtgaaaatcttcacacacaatatgcttccaatgagcatgctcttatgcatcaaagaggaaacaaagcatttcaggattatgtttgtaaaaggattgtttttgaaaaaaataaaaaagcatagagcaaatttcagagtggaaaaacatcaaaggcttttcaatagtcaaactcatcactagatttaaggcaacatttaaagcaagacatctgtgttatttatataatatcaaaaagaaaaagcacaaaggtagactcaagacaaataaagaatccacctcctatgctataaaatacttcttatgtttgtctctctaacagtatgctattattctagcaaggcaaatatgttcttaaaagggtatcatgttttgtatgatgctgatgagcgcagctttttcatgtgtcttgcttaatgcagctaaatactacgaatgctattcagttatcaaagatacaaagaaccattcaagtttaggaaattactagactctttcttacagaaacacaaattattataatgtattgttttcatcttcctgcccaatatccaaactttataatccattctatttttctctcacattgtaccatgagacacttttactgcgagcagtaagtatgagaatgcaaaatctagggaggggtgaaaagaagtaaaagaacaacaatgtaaaggaggggaagctgacatggagaaggaaaaataggattcaacactcttggattcagttattaattcttaacaaatgtccccagggagctcacccagtatttctagaccagatggaaaaaacagtatgctacagcaactctatccctagacccagctgtcatgaggaatagagaggcaatcccagtaaggaactaacatctaacaccatacttcatgtgtgctgcgccattcatatacaggctgaccttaagatggtgactgttttgtttgttggttggtttttgttttgttttgctggcttcttatgtatgtgcctctgttttttatatcaatccttgacctctctccaaagtccaatcatgcatttccaggccctgccaatgatctcctttgtacctttaagtcaacattccccaaaaccattcattttctcctaaacctgaaaaaaagaaaaaaactccaccacttgactttttccctgtggctggcaacaccattctctcaatccttcaagcattacattttaaaatgataactgagttttccttctctctcttcatcatatcaagatcttgctggccaggcacagtggcccacacccgtaatcccagcactttgggaggccaaggcaggtggatcacgaagtcaggagattgagaccatcctggctaacacggtgaaatcccatttctactaagaatacaaaaaattagccgggcgtggtggcacacacctgtagtcccagctactcaagaggctgaggcaagagaattgcttgaacccaggagacagaggttgcagtgagccaagattgcaccactgcactccagcctgggtgacagagcaagacaccgtctcaaaaaaataaaaaaaaaaattcttgccaaattatatagcctaatagcaaaatatttgtcaaaagtcgatccccttggccaagcgtggtggctcacgcctgtaatcccagcactttgggatgccgaggctggaggatcacaaggtcaggagatagaaactatcctggccaacatagtgaaactccttctctactaaaatacagaaattagctgggcgtggtggcacatgcctatcatcccagctattcaggaggctgaggcaggagaatcacttgaaccagggagtcagaggttgagttggaggttgcagtgagccgagatcacgccagagcactccagcctggcaacagagcgagactacatctcaaaaaaaaaaaaaaaaaaaaaagtagaacccctcttttccaattttgttatgtaattccatcccaaagtttggattacccaggcctctcacttaaatggtcacaaacacctaactggtctccccaccttcaatctctttatccccaattcattatatccactgctattaaattaatattcctatggcacaactgtgatcctcctcctccaattctcaaaaatctttagtgaattcacaattattgaaaatatttaaaatcttttagccatgaaaatcaaaggttttcatgatctcacctcaatctcacttttcaaaatgatctcacacaatctccttcatatactccatgtttgaaccactggactacatattattaagtgaaatgtacctgagcttgcacatcttgtgtctttattcacactaatcttccctccttgtttgctgtgatagggactgtgctagatagtatgatacaaagatgaataatagatcttatataggttctaagcttcttagagaagcatgagctttggaattagataggactggggtctgaattcagattctgcaattgccagctgtctgatttggggcaagctcttaacctgagagacagctttttgagctgtgaaatgatataataacatctaccttggaaagttgccaggatataaattacatattttaaaagcatgatatggtgtcttccatttaggtaagtcttccttctgaaataccaacattagcttccccaagcagaatgcactgatgacaataatgagttagctgtcacctgcaaagatcctgagttagtacagacagagaacaattgcagctttcctctactccttttcttccttgcagagacaaatgagggtgacctcacagtttatgcctcgtaacgtttgcctagtgatcttttccattctccaacaccatccaggcaataagcatcaatgttaatgagctgctggacagctttgtgaaactgactgaaagagccagataggtattggtgtcctacacatgcaaataatatactttcccttcaaatgtactatttttatataagtttcaaaagttacatcctggtggaatgacagtacccaactgaaatatgttttccactctatgttactgcttacttcaacgggaaaagaatatatttacactttgccatattatgtaaacatggaaaactgagctaactagtgtcatgttattaattgactccagtgatattttagcatcctttatagattggccccctggactcgtaactgcccgtaatccaagtatgtatatgtgaaataacctcaggggtcggtgggagggggaaaggggttatttacacagtgtttgaagaagtgcaacacttgcagtttcaattccagaagtagtaggtaccgaggcatcctggatagactgtaaaagagtagtcaagaaatcctggcagttatcaatgactagaagccaagtaaaagctgcaagtcataattgctggaaatttgtttacatgcaacagtattttcaagggaaagtaagaagcagagggaaaagggcttgatatagagcagacatccgaacccaagtacttaatagtaggaggaaaaagaaggctgaaactagcttagaagccatctaaaaaagaaatatttagttggtctttatttacactaaattagaaaaaattttacttaaacctatgcctcagtctaaatttcccagtgaacatttgtggagatttggctatctagaatccatttcttccttctttgggcaacagcatccttatttcattttagagaattccctcctctctattgtatccagtcttggtggtgctacaagtcaacatgccctgtgctcctctaaccagtaatcatccaagctatgccagtaagactctccaaaatttaaatctaaagtggagtagcttaagaatggaaaaggataaagtcccagaaatagcgctccaacaaaactattgtgagtatcttgctgttcagaaaccgtaagcctggtcactagcttttaccttaattctgctgactacccaataatctttcaataaattcctttctgcttccttaactagacttggttcctattgttggcagcctaagaagccctgataaggaattaaagccattttgcctaactttgtccctggtctttccaaatgaaaactacaaatatttgaaaacaaaactaccctatagtttgttgaacggtgtttttatggctctattacagaagtatccagcatacttgcatttttcaagcacacaaaacttaaagggggcatttttgtttacttttcctacctcattttcagcagtattcactctattcccactgtttcctgccacgcttccccattacacgattttcttcataattgggccaaggtttactctagtaacattagctgtattgatttatttgtacatttgctgtctcgagaacttaagtaatttgagtagctcatattattgtttacatgttcaattatcttgtacttcttaacattttcaatgccattgcctttattctagtatcttttcacaaatatgcattactgtattaagtacaatgtgtccaaaattaattgttaaaggtatgataccagtatttgttcccccaggactcttcgatgaaataaatcagtaaaagaaaatctaaatgtataatttataaatttatagaaattgagaaatctgaaaaatgtagtgatcacctaatctaaggccataattttatagataagggaataggtctccctaggccattatccttgattccaacatctccattgatttattttgggttttatgtgttttctgtcattgcaaggggttcagggaaaaagatagcaactgtgtatgtccggtaatccctcttaaacaagaggaaaaagggaaataatctgacatcccaacttaaatcaggggcaccagtaatctcacagtaatttaaaggtcaaagtttacagttatcttaaatttttatttaaatctccttcctattcacctggccactgtaaagattaaatgaaagtaatttgtagactataaaatgttatatgagtcaagattttgttaatattgctattcttcatcctttcccttcccacggcacaaacatagagccattatggccttacatcaaaattataacacaaaccaataaagcccccatcccctccccattgcaacccatcctataagacaactttttgtactagactttcaattctttcaaacttttaagaaataaataacaccaattatatcagtctattttcacactgttgatgaagacatacccgagactgggaaatttataaagaaaaagaggtttaacggactcacagctccacgtggctaggaaggcctcacaatcatggtagagggcgaaaggcatgttgtcttacatggcagcaggcaagagagagaatgagagccaagcaaaaagagtttccccttataaaaccatcagatctcacaagacttactcactaccacgggaacagtatgtgggaaaccacccccatgattaaattctctcccaccgggtacctcacacaatacttgggaattatgggagctacaattcaagatgagacttgagtggggacacagccagatcataccaccaacattacacctactcttccagagaacaggaaaatataaaacacttccaaatgtgtgttgttgttgttgttgttgtttgaagccaggatagtattaatatcgcagcctcacaagaacattgcaaaaaagcaaagtcaaaagcaaatcctaatcgtgaacatgagtacaaaacacctgaacaaaatttcagcaaatcaaatcctgcgatatatagaaaggataataaaccatgatcaagctgggtctattctaataatgtaatatcatttactacagtaacaggatgagggagaaaaatcatatgattatctcaatagatgcagaaaaagcactctataaaattcaacaccaattaatgatttttaaaaaagaaactagcaaactggcaataaaatgaaactgccttggactgataaagcaaatccaaagaattcaaaagtcaggatagtggttgtcctttgggagtagtaaatggaatgagtaagaaaagagcttcagaagagctaatttctttatctgaatgcttaaaacccaaacgtggcaagttcatgagaatttactgagctgtacaaatacagtatgagcactttcttctatgtatattatacttcaacaataaaaaaacctatagcagtcatacttaattatgaaataataaaagttttcttcttgaaattggaaattacacaagcatgccactaacaccattgttcttcaacaatttattggagatcctaggcagtgcaataagaaaaagaaatagaagacatgaaggacgacaagaaagaaatttcatgcagaaaaccccaaaataatctatggataaagtattagaataaaaatacatagcaagattattggatttcaggtcaaaatagaaaatcaactgtttctatatatcagcagttaaaaaaaaagtttttaaatgacaccatttataacattaaaaatatccaacacttcggaaactaatggaagatatgcaaggtccttacagagaacactataaaacattattttaaaaatttaaggaagaggccgggtgtggtggctcaaacctgtaatcccagcattttgggaggccgaggcgggcagatcatttgagatcaggagttcgagaccagcctggccaacatggcgaaatcctgtctctactaacaatacaaaaatagccgggcatggtggcaggctcctgtaatcccagctacttgggaggctaaggcatgagaatagcttgaactcgggaggcagaggttgtagcgagtggagattgcgccactgcaatccagcctaggtaacaaaatgagagtctgtctcaaaaaataaataaataaattttaaggaagaaataaatggagagatatatcatgctgatgaaagagaaaatactgaaaatgtcaatttctccaaattgttctatagattcaatgtgattccaatcaaagtcccagcagaatttttgtggaaattgacaagatgattataaaaattaatataaaaaaatcaagagaattttgaagaagtgggaggaggtacaccatcagacaactagaataattaagacagtatggtattggcacaaagataaatgcatgaaccaatgaaacagaagagggtgcaaaatagactcatacatatattttaaaagattgggctgggcacggtggctcacgcctgtaatcccagcactttgggaggctgaggcaggaggatcacctgaggttgggagtttgagaccagcctgaccaacatggagaaacccatctctactaaaaataataataatacaaaattagccaggcgtgctggagcatgcctataatcccagctactcgggaggctgaggcaggagaatcacttgaacccgagaggcaaaggttgtggtgggccaagatcgcgccattgcactccagcctgggcaacaagagtgaaactttgtctcaaaaaaaaaaaaaaattgtactgcagagccacagagaaacaatgatcttttcaacaagtggtgctggttcaaataaatatcaatagcaaaaaatgaaaactgctatatgcctcacatcatataaaaaaagaactcctaatagatctatgaaaaaataataaaatatcttaaaagtttacataaatgaataactcatgacctttatataagcaaaattttctttttctgtcctttaatttcaacttttttttcttgctttttttataatttcaacttttattttagattcggggtagatgtacagatttattacacagatatattgtgtgatgttgagaattagggtacaactgatcctatcactcaggtagtgagcatagtattcgatagtttttcaactcttgctccgccgtcactcccctttctagtagtccccagtttctattgttgcaatctctacgtccatgagtacctaatgtttagctcccacctataagtgagaacctgtggtatttggttttctgctcctgcattaattcacttgggataatgtcctccagctacatccatgttgctgtaaaggacatgatttcaatcttttttatggctgtatagtattccactgtatatacgtatattttctttatccaatccaccattgacaggcacctcggttgattccatgtctttactattgtgaatactactgaaatgaacatatgattgcatgttctttttggtagaacaatttattttcttttggatatagacccagtaatgtgattgttgagtcaaatgatagttctaagatatttgagaaatatcccacctccacaatggttgaactaatttacattcctaccaacagtatgtaagtgttcccttttctccacagccttgccagcatctgttgttttttgacttcttaataacagccattctgagagatggtactcattgtggttttgatttgaatttctctgatgattagttatttgagcattttttcatatacttgttggtcacttgaatgtcttcttttgagaattgtctgttcttgtattttgctcactttttagaagggatatttggtttttgctttttgaaatgtttaagttccttatagattttggatattaaacatttgtcagatgtatagcttgtgaatattttctcccattccataggttgtctgtttactctgttgatagtttctcttgctgtgtagaagctctttagtttttaaattaggtcctactcgtcaatttttatttttgttgcaattgcttttgagacttagtcataaattctttcccaaggccaatgtccaagatactgtttccaatgttttcttctaatatttttatagtttgaggtcttacatttaaatctttaatctgtcttaatttttgtatatggtgaaaggtaggggtccagtttcattcttctgcatatagctagctggctatcccagcactatttgttgaatagggagtcctttccccattgcttatttttgttgaagatcagatggttgtaggtgtgtggcttcatttctgggttctctattctgtcccattggtctatgtgtctgtttttgttctagtaccatgctgtcttggttaccgtagacttatggtatagtgtgaactccaataatgtgatgactctggctttgttctttttgcttacgattgctttggctatttgggctctttttttagttccacatgaattttagaatagtcttttctaattctgtgaaaaatgacgttggtagtttgataggaatagtattgaatctgtagactgctttgggaagtatggccattttaataatattgattcttccaatccatgagcatggaatttttttccaatgtttgtgtcatctataatttctttcagcagtgtttagtagttctccttgtagaaatatttcacctccttgattagcagtattcctaggtattttgtttttgtgtgtgtagctattgtaagtgaaattgtgttcttgatttggccttcagcttgtacattattggtgtatagaaatgttactgatctttccacattgatttcatatcctgaaactataatgaagtcatttattaattccaggagccttggtgcagtcttacaatgttctaggtatagaatcatatcaccagcaaggagagacagtttgacttctttttttcctatttggataccttgtatttctttctcttgtctgactgttctaactaggacttcaaaattttcttaaattgaatacaaaaaacactaactacaaatgaaaagattgataacttgcattagctaaaattaacaactattattcgtcaaagacaacattagaaagtaataaggcaaaccacagatgggaaaaaacatatgtactaggatggctaaaattaaaaagattatcaataccaaatgttttggataagaactactcatgtatttccaggcggagtataaattttttacagccactctggaaaaatatgcatacactataacctagcaataccatttttagatataacagaaatgtgtatgtatgtgcatgtgtgtgtataccagttagaaagaagcatgagggtgtttcttagtactggtaatgttctgtttcttattctagatggtacttgcataggtcttttgcttcataataattcataaagctgtatacttacagtcagtgcccttttctgtatgtatgatatacttcaatttttttaatcaggggaaaaataaggagagaaaatcaccaatgtgaaacaaatatcagaaatgcccatccaggaacctgaaatcatttctcactggcacaaacactacccagtgataaaataaggacttgatatttagacaacaacaaaaacctgatgtttcagtttatctatacagccttagtaaatgtaagtatgtaatttcattaagctttctgaaatgctaaaaacaattttaaagattcttattgtttttgtgtacccttttgtattcacagatcccagattagaaattagtgccctagtctgaaaagaaggatcaccagacaaaaatattcagtaaatgttgcctcttctctttataatctatatgttaggtttacactgaaaactatctctttagggaaattatatagatacaccaatcctaagtaaacatttttaaataaaatgatgagggtcttattctcaattgtttccaacactagatacattataaaaagaagttttgtccctataacccccaaatctatgttctttgttaatcagtgtgtcacagttcaaatcttaatcacatccaaaattttgtgaccttgggcaaatttcttaatctgtgtttcaatttccatatctggagaatggggatgatgtgactaatacctacctcatagggctattgtgaagattaaatgcaataatgcatgtcaatcacttagcactgtgtctaaatgttaggctattattattatcaccatcatttttgcctatttatttattttttaaagtaaaacactaaattgctgattacaaatttgtgagcatgaggaagactgttgacataagggcttcattctcagtgatcatgttaggaagtaaccttgtactgggggatttctagatatcagtatatgaagtcttctttggagccactcgattctttcaaagaagaatacatttttctcctaacctggaaagtgctgtctagttgatgatgctgtgcaaaggaacaggaagaggagtttaactgctccatagatcaactttctacctatccctttgtttactgcttaaagactcattccctaccctcagctctacctcgtagttccaagcccttcaaatatttaaagatagccgttattttattctgagtcttctcttctccagttagacatacccatctcctttaactatttacagaccattctctttcatcatcagtatattcattcaaatctctgttattgtgatggttaattttatgtgtcaactgggctaggccacagtacccagatatttgatcaaagattccatgatggcaatttttaaatgagaataacactaaatcagtagactttaagtaaagcagattgccctctgcaatctaggtaggcctcgttcaatcagttgaaggccttaacagtctgacctccctaaaggaaaaggggattccaccagcagaccacctttggactggaactgcaagtcttccctgagtctcctgcatgctggtatgctctgcagattttggacttgccaaatctccataatcttgtgtgccaattccttaaaataaataaatctctctctctctctctctcacatatatatatatatatatcctgttggttctgtttctctggagaaccttgactaaaacagctatgcttcaggaatacaagtagaaaacactacctacctttgtggatatgccagtctaacctcactttattatatccaaataactcttaaaactgtttctaggtcacatggacctatgcaatcagaccaatgcaatttgaccataatatagaataaataaactgcaatttcacctccctaatataattattttaccgcaaccaaagagcaacctaatccacatcactgcttatattgagtttaccataataaaatccccaaaaacttcccacaagaactgttacagctcaccaattctgtatttgtgaattgttttggggggcctgcacataatacctaacattttttcctactaaattttatcctctgaaatttagtttttcattgactgctgtcaagatattttggattccagattctgtcatttcaatacatttacaaatactctcagctccatactaatgaaatattagtctttatcaaactaaaagaggcatagctaagatcaagagaagtctctgacatcatcaactataaacaaagcctgaattcaaataatactgacatacatatgctgctattaaaattctcagggagtattagatatgcaaggaaggtgggacatatgctgctccagacaggcctggtgtcaactgctgtctctaaacttacaagttttataactggacaatttgcttattcctcaaagagtttcaatttccttttcaataaaatggtaaagataaaacttacatcacaagactggtgtgatgttcaaaatacacataaagcacttgacagaatgcctaatacattgcaaatacttgacatgtgtctactttgaagcacgtattatagtaagaactcagcaaaggtgagatacattcctgcttcatcactttcccttggatcaactataacctaaataacttaacctctcctggccttggggtaaagaggtagacagagggggagagaggcagatggaagaataaagttgctgcatgaagttgctacctaaagagactattttaaaggctgagaatcctttaaaagatatcaaatagtttagaaagatgctttgacttgggctgttagaaaactgcagcttctagtcagaaaagaataaatgcagtgatgtttgggatttggttaaacatttaaattgcatttcaaaatgttggatttggcaaaatttaaaataaattttgccaagtccttaagttttttacttgcatgtattcaagggaaagccagcttgtagatttgaatcatttagatttaactcattaaaatgtatagagtgctttatcaagccacaaaaattgtgccccaaatcatttacagtttaacttagaaaaaaaaaagtcttatataaaccacagctcttgtacactaagttgctgagacttagaagaaaagattaactcagaaagacctcaagaaagaaagaaattttgaagaagtaatgaaaggagtggaatagcactgaatgcacaggaaatggaaaaccattccaaggatgcagacagaagtgatattacataatagctgacacagactatatgcaaatttcagtgattggattttgacttaaagatattttcctgaaatgtctggaagaacaatgggactttgggggcatccataaaattataatcaagatctattcagcagatgtttactgtgtgtctccacgtgcaaagctctctaacaagcactgagaaacaatgctgaatgggacagacatgtccttgccttttggaagcttacagtctattgacaaaatagacttttttatgtgaaaacagaaaataataagggctaggaagtatcaagatgtaggaagcagtcgcattatacacggattttaaggtgtaacataaaagaatcatacattttcaatttcttagggactttgaagttcatcagtccagtttttccaagaggaatccaagacagcaatatgtaaactgcttcgattgaggtagggggcaaaaggaaaagcaaagccagacctggacacaggtgtcctaactctatatcaaacatccattccttcattcaacttttacgtgatatttactatgattaggcactgtgctaagtgctgcagaaaaggtaaaaattaaaaacacctctccctaacatggtcctggaagagagataagtatgaaaataaacaatccccaaaagataaatgatgtaacagaaaaattgcacaaagttgtgcagcacccaaaagcaagaccctctctgcttaggaagacaatggtggctttacatcagccaaatcatataaaatgagtaggattttcccaggaacataaaaagaagagaattcaagaaagaagaaagaggccaggcgcagtggctcacgcctgtaatcctagcactttgggaggccgaggcaggcgtatcatttgaggtcaggagttcaaaaccagcctggccaatatggtgaaatctcgtctctactaaaaaatatatatacaaaaaaattagccgggagtggtggcgtgcctgtagtcccagctactcgggaggctgaggcaggagaattgcttgaacccgggaggcagaggttgcagtaagccaagatcatgccactacattccagactgggcgacagagtgacactgcttctcacaaaaaaaaaaaaagagagagagaggaaagaaactgtgcaaagaacactgtatgtttggaaaagtataagtataaaaagtatgagttcttttacttctgagctttttttcttaattagttttatcaaagtaatacatgcacatagtcagatggtgcaaaaagactcgaaacacagcagtcctgtggccacccttctgctggttacactaccatcaaggttctctcagtcccagatgcaaccatgttaaattggtttagctgctgcttctggcatttagcgccatgcttctaaatcacgtgtgtctatactgatatactggtatcctacacagtataagaactttcacctcatacccacttcacccccccaccccagtccccaatatggttgaaacataatgtggggtgatatccataattgtagttataatgactaagtaaatattgcttgctgattaaggtattatactctgactatatttcctctctgtgataccttttcctttttctaatgttgatttgcatgtacttgattgttctcttctactctctggtttaatcttcccccacattccaatggctctaaagccatttctaaataccatttttcttatagtcaaacctatcagataatctatttttccccatgattatgccccctagaaatctgcccctgtactcaccccttggcctgtcctaggaattccttctgtctatggtgtaaaccaagaaataggaagcctccaaatctaggaaacataggctctaacaatctcactttgatagaacccacattctactagcttcctgagaaagaatgcatgagaggtaaatttattttcatacatttgtcagtcatccttgactgatattttaacaatgtaaacaattcaaggttgaaaattgctttccttcataattattatcttctagtttctagcgttgatttgtggggcttttcggcttctcaaagtatgagttaggattgtgtttagttgtaggtaaaataaaatccaacaagttataacttagccaaatagggaacctgaccaggtgctgaccacacctgtaatcccaactctttgggaggccaaggtgagtggatctgctttgagcacaggagtttgagaccagcctgggcaacatggcgaaaccccatctctaccaaaaatacaaaaattagccagacattggtggcttgctcctgtagtcccagctacatggaaggctgaggctggacagtcatttgagcccaggaagtggagggtgcaatcagatcactccactgcactccagcctgggtgacagagtgagaccctgtctcaaaacaaacaaacaacaacaaacaaatagacaacctcccacccccaatgtaacaagaaatccagagacaggtagttgctgaaattgattcagcagttcaggtatatcagagctgagaactctgtgattctcatggtcgcaaaatactgtagctccagacatcttgttcaggtttcaaatgagaaaaagtagaagagaaaggagaagattcaacagatttccacttacattttatgggccagcactttaccacacttggtcatatctaactacaaaggaattgaaaaaagtaagcttttagctttccggcctctacaatgaagaaaagcaagggttgaaagagacaaactggaatatgagataacattacaatgtgctttggtgtgcgtcttttcaaaaatcttttgtgctgggcactctttgagtccttctaagtttgaaacacatattttcagtcctagcaattttccttttaaaatttagttgatagttttatcctttttgttttttcattctctctggagagctcctaaaagtcaaaggttgaacttctgatactgatcatctatcttttttctcctatttcccatctcattatctttcacttcttttttattttaagttccgggatacatgtgctgaatgtgcaggtttgttacattggtattattttttacttcttttttaggagacttcctcatctgcatttaacccttttattgaatattttatttcttaagtgctttcttactctcttattcttccttttctatagtattatgtttttattttatggttgcaaaatcttctcatctttctgagggtactgattataattccttgaagttttcttctttttcctgacagtctttcttctgagctttattttgttattgttattgtttatttctttgttagttttgatctcttttcctgttggagtttctccttaattgactggtgataattgattctgtgtcatatctaagaatgaggtactagaagggtgactagaagctgcgtgcatgtggccaaagcttaatgagtagtaagctttactaaaggacaatcaggaagcccgttagtttcctcatcagggaagcccacatgtcagtatctacagagtttttctctgaagcatgttatcccttcagagaaggatcacctatctgaagaggtgttaagagagaaaggcagttataagccttgctgctactgttgtagaactcagcacaggaaggcagctagaagtctcaccattatgcagatcacttaattcccctcactcctatcctccctactttgcagtctctcaggttcagttcttcacagattatacgtttcatatgcagcagagacagggaagtggcagttgttagtgcctagtagggatgactgaaaaatataattaattttaaacaattcttttgtttgtatgccacccacatcatctctccctcacaatcacactccaacttccataatacctaatttctgattcctaagcctatctcagattctgcaggatgaatcagtttgtttatcattggtatatccctctgcagataattagattttacattcttgctgctaagttatctacaattcttccatatgctttcaattttcctatactacagatgaaggttagagaaatctagttttcctaaagatggaaagtacctgttgcttttgtttgtttgtttgttttaagtgatttctagtaaagaagtactttttctgccattttgaaacaggtaagtctctaattatgaatttaaaacttgaagacattgatagatatgaacaaaatatgctccagagcaaaactctacccattaacaaccagatcatgcacgaccagattagaatggccattatattgttggttatccccattctggtaatatgacgtagcagctaagagcatgagctctgaggtcagattgcctagccttaaatcctgtctctaccactttacaagatgcataatcttgcacacattctgtttatattatcctcttgacctgaaaaaatgtagagtgatgatgaggattaagtgaacaaaatgcctggcacacaagtattcaatatatacaaactactattattaactccaacagatcaaattttccaaagtagtgagagtaatatgcactaagcgccttacagatattaacttactgaatcctgaaaacaatactatgaggtagggatatcaccgtgccaattttataaaagataaaactgatagatgaacaggttaaataacttgcccaaggtcacacggccaaaagtagataacagggattcaatctgaagaaatctggttccatcgtctttgatcttaaccacttacaatacacagcccaaggatagcatcattcaaatttgagtccccaggttctctctagctctcttatggaatgccaagtaagttatattcggtaccacagactaacttaaaggaagatttcaaaacgacactgcaaaatttggaccaaattatttctccatttaactgccttctatgtacaggtagtagtatagaatagttgtgtacatgtgatgctcatttccataatgagtaaaggacataaaacataaaaatatcatgcagtttttaggcctattgctcccaaatcattcactctgattatatcctttattacagggaaatgtgttttctaagtctatcttctttgcatggattgaaagatttgtgaaactgaaaactaaccttcctctgccaagagccccatcaagacagaagttcttaattaactaagcaattagtcataacaagtgaaagctaaaatggagcatgaatacataatttgctgattatttttctccactagaacccttagccagaatttaacaaaaagtgttctgtgggtgctagttttgggaaggatggtaaaacctggacagaatgcactgaacagctatttgagggctccaaagagtaaagaattgcagatggattggagaagaccagaattcaaagtatcagcagtgcgtttcttgtttttccttagtatcccccagtctggtgtctacacctggtacaccaaaaccaggagtagacaccagcatacaaacagagagatttccagagaagtcctctagctctggctcaacaggtaggaaaacaaagagatttctaacactcagagagagtgggggaaattccaggtttttctcttatatcatcattattacttatgttttctctctttcatgcctcagtctccaggccatcctgtggcagtggcagcagcaacaatggcaagcaatggagtgattcacaggtgcctgaaacttggatagaagtgtagtccacaagagagaggcaaactcctactgctttttctctctatctctgtttacctacctcttgaacctaaacatgggtacaactacaggatgtgtgtggcagagcaggataactaaaactccagtttgtggccaaggaaccaaaaaatactggggatattgcggagaaagggttgggatatgagcccgtcctgagctgcacatacagagatatgatcttgaacacctaacaaagacttgagaaatgaattaaactactgaccactacccagatctcagactggctgcttggttgcaaatatgtgggacagagcaaaagagcatcacagagcgtttgaaaacgaattgacactgaaaccacaagccactgaaggctgatcagaccttacaacctgaattctctgggttgattgcatgctaaaataaaaatatcaacattcaccataggatgtaaataagacccagagtctcataacatgatattcaaaatgttcagaatataatacaaaattactcagcattacaaagagccagaaaaatttcaaattacatagaggaagaaatttcacagacatcaatgccaagatgatacatatgttagaattacctgacaaagatgtcaaagcagctattaaaaacactcttgaaataaatagaaagtttcagcaaggaaatagaagacgtgaagaagaaccaaatggaaaatttagaactgaaaaatgcaatagcaaaactttgaaaactcactgaatgagttctgtaacagaataaaaatgacaaagtatcaataaacttgaaagcagatcagtataaattatccaatctaaacaacatagagaaaaatactttaaaaaataaataagagcctcaggacctgtaggacaatatcacaatgcctaatatgtatatcatcccagtcccagaaggagagaagagagagtatagtacaaagaaaaacaatgtaattgctaaaaactgaccaaatttgccaaatgacataaacccagaaattcaaaaagttcagtgaactccaaaaagaataaaccccaaaatacccatacctagacatatgataatcaaacttctaaaaattacagaaaataatgttggaaagtaaccaaagaaaaatgatgcattacttacagggaagcaatgatttcaaagtctgaggatccctcatcagaagtgggagctaagctatgaggaaacaaaggcataagagtgatataatggactatagagacttgcgggaaagggtggggaagggggtgaaggataaaagacaacacaatgggtgcagtgtacactgcttgggtgatgggtgcactaaaatctcagaaatcaccacctaaagaacttatccatgtaatcaaacaccacctgttcccccaaaactactgaaatcataagaagaaaaataattttttttaaaaaagaagtcatggaggccagaagaaagtgcactcatttttaaagcactgagaaaaaggaaccatgaaaccagaattctgtatctagcaaaaatactcttcaggactaacaatgagataaagacattcttacatgaagaaacactaagagaattttcattagcaacagacttctctacaagaatgactaaaagaaagttcttcagccagaagataatgatgccatatgcaaatgtggaacatcagaaaggaagagagaacaacaggaatggtaaatttctgggtaaatataatagactattctttcaccctgagtcatttagagtatgtttaacagttaagagcaaaaaacagagcattgtctgatgagattttcaatgtgcaaacagagtccaaaactaggcctacaaaagtatgatcaatgggtttttgacgaaggtacaaaggcaattcaatggagatatgatagttttttccataagaggtgttggaacaaatggacgtttcgaagcaaaaaaacaaacaaacaaaaaaagaacctcacgcattatacagaacttatcttaaaagagaacatagacataaacataaaacataaaactaatttaaaacatcaaatatagttttttgagtaataattggaaaaaatcttagtaacattagtttaggaaatgatacaccaaaagcatgattcataaaaaaaattttgataaattggacatcatcaaaataaaactcttgctctgccaaagaccctgtaaagaccatgaaaagacaaggcatagacttggggcaggggggaatctgcaaatcggccgggcacagtggctcacgcctgtaatcccagcactttgggaggccaaggcgggtggatcacgaggtcaggagttcaagaccagcctggccaacatggtgaaacctcgtctctattaaaactacaaaaattagccaggcgcattggcaggcacctgtaatcccagctacttgggaggctgaggcagaagaatcacttgaacctgggtggcagaggttgtagtgagctgacatcgtgccactgcactccagcctgggtgacagagtgagactctgtctcaaaaaatctgcaaatcatatatcaaacaaaagatttgtatctgactatatgaaaactccccaaacttaagaaaacaaacaactcattaaaaaaaataaatacatgatttgaaagaaaacttcaccaaagaagatacatagatactaggttggtgcaaaagtaattgcggtttttgtgattactcttaatgctgaaaaccacaattacttttgcaacaacttaatagtaaataagtacatgaaaagatgctcactgtcattagtcattagaaaatgtaaataaaaatccacaagaacatgctactacacacctattagaatgggggaaaaacagacaactgcaggtattagcaagtatgcagagccattggaactctgaaacattgctgatgggaatgtaatattacagccactttggaaaagtttggcagtttctgacaaaggtaaacattcatttaacttatgacccagtaattccactcttagttatttgcctaaaaggaatgagtatttgtttcacaaaagcacctgtacatgaatatttacagtagctttattcataaataaaaaatgcatatgtccttaaactggtgaatggatggaacaaaactaattgtggcacattcatacaacagaataccactctccagtaaaaatgaactattgatacacacaacaacatgggtgaatcacaaatgcactatgtaaagtcaaagatgacagatgtaaaacactatataccatataattccatttatatgacattctggaaaaagcaaaaaaacagggacagagaaaagatcagaggttgccaaggattagagctagggaaaaggctgactacaaaagagcagactgaaggcattttcagagacaatggaaccctttagtatgttcattgtgatggtggttacacgattacatatttgtccaaactcatagacctgtacaccaaaaacagtaaattttattgcattttaacgtttttaaattttaaaacaaatttacctatttaaaaaaaaaaacaaagacagcaacaacttaggatcccatattaccatcactatttaatgtgatcttagacaaatcacttaatatagagctttggttcccccaatttttaaaatgaaaaatatagtatttatatctcataggtctttataaaaaagttttttaaaggtttcaagatcctgccttttcacattctatttcttctgaaatgtttcttcccatcctctcttccctactttgcttggctaaatgctatttgattttcaggtctcagcttaaacgttattttttcataaaagcttctcctaactcacattttaaatcagggcctcagctatgcctttactgcccagtgtactcttatttcataacacttctcatgtccttttttttttttttttttgagacagagtcacccaggctggagtgcagtggcccgatcttggctcactgcaagctctgcctcccgggttcctgccattctcctgcttcagcctcccgagtagctgggactataggcacctgctaccatgcccagctaatttttttgtgtatttttggtagagacggggtttcaccatgttagccaggatggtctcaatctcctgacctcgtgatccgcccgcctgggcctcccaaagtgctgggattacaggcttgagccaccgcgcccggtctttttttttatttcaagagcttaggcgtacaagtagtttttggttacctggctgaattttgtagtggtgaagtctgaagttttagtgtacctgccacccgagcagtgtccattgtatccagtatgtagtttttttatcccttacccctcttctactctccttatttctgagtcttcaatgttcattatatcactctgtatgcctttgcacgcccatagcttagctcccacttataagtgagaacatatggtatttggttttccattcctgtgttacttcacttagaataatggcccccagttccatccaagttgctacaatggacattatttcattctttattttatggctgagtagtattccatggtgtatatataccacattttctgtatccattcatcagctgatggacatttaggttggttccttatcttttcaattatgaattgttctgtgataaacatatgcaagcacatgtattttttttatagagaggttgtactaacttacattcccaccagcagtgcacaagcattcccttttcaccacattcacgccaacatctttgttttttgattcttaaataatggccattctggcttgggtaagttggtatctcactgcagttttaatttgcatttccctgatgattagtgagtacatctataggtaaataattttatttaatgtctgtctctttcatgaaatggtaagctctgtgagggaagaaattgttatcagaatacaagcagtacaaagtgtctgaaacactggtgaatattctgtacatatttttaaacaaatgtgcaaaaacacaatggcatttcctattgtgtaattaattctttcttaatatctttacctttctcactatttatatgtatagacacatgtatcttaatgtttttatcttcctcaccctgtatatatacacatacatatatatgtatgtatgtgtatatactatgcataccatcaacaaagtttcttagcaaatgtccatcaaaagataacaaataatagattatgccttggttgacatacctgtttactaacttttcctcatttgtagtcattaacactaattgaacctgacaaaaataagatgtgacagacctactgtatatccacaagtcaaattaacaaattagttgaagaatcaatacatctacatatgagtctactaactgttgggcatacatccagacttacatgcagaaaagcacttaagaaccaaacctttttccctcttatataagctgtcaaaaatgttacagatgtgacatttaagaaactcagagcatgacttatagattaccttatgcataatggtaaaaattcctctagaacaaccagcaacattaataattagttggaactcaattacggatacttgccaaagcaaatccccagaaagctatcttgtatctttcaacctggccttgtagaaatgatctaatgtagcatcctacagtgtaggtacgtggggtattaatatcccaccctccttgatgggtcagtaactgaaacagtgaaaggctcaatgaagatcgcagcactaataaacgatgggacaggtattaatactgcaatgccgcactgtccaatatggtaaccactgagccacatgtagctacagagcacttcaaacgtggctaatccaaatcaagaagtgctgtaagtgtaaaatacacaccagatttcaatacttggtacaagataaagaatgtaaaattctcattatttgtttatactgaatacatgttgaaatgactatgggttggattaaataaaatcattattaaaattaatatcatctgtttcttttcacgtttcaaagtgtagttactacagatttttaaattatatatgtagcttgtattatatttccagcggcatcatgatagagcactcctggatcagtatggttgaataatagaagacatgtggaggcaaacatttaggtttacttcccagactctaccatatacacacagagtgactttgcagaagattattgtatatcactaagatgacttttcccacatttaaaatcagaacattaaatctatgatacagtactagtacgaggttaaataatacattaaaggtctaataatgtattctacaatgaatagccacttgatgttaatttctcttttcctcctttttcctaatccacttccctgttaatttaagctgcagttaaacttccatagtggacagattagtccccatgcctactattcccagtacctcggtctaggttaacacaacctccatgaccagaaaaccaggtacagaatggtggtcactgagtagcccaaagtaggtatgacacaagtatgacctgtctgtagtttggcatagtctaatacaatgggctcaaatagtgaaaaacagcatatctgctcccttcagaattcatccaagaaacagagacagactggttaataacaaaagggtaatggaagcagacgtagaaagagacatagaagtaacaagatggaaaagccattcatttgttcactccacaaatattaatgactgtctatttattacatgctatatgacctgagagaggaagtaacaggggaataattcccagagctttataagacccagacaacttccagttccagtccaaatgtctctttacaataaatattttttctttagatgaatagatgaaggctctgctccttgaaactaaaatgacctaactaacgtagcttcacaaaggaaggcacagaaaagtgcctttttgttagacactcacacacacaaagacaaaatatgtattgccctaggtaataaatcaaacaaaaagggttcttcctcaaagtgggccattcctttcctaaaaccagtaacagacagaacagaaaacaagtggagatagcaagggctactgacccttaatattcctttagaaagccactaccagaaatacacttttaagtgccttacctgcactgcatagaaatatgtaggcaaagagaaaaaagatcggccaactaaaactacagactataagtacttattaaagactactttcactaacataaatgggattcactacatcagagtcccctgatcactttttgcagggcagtctgtgggcctcactaaactaatttgcgatattaaggtaaggaaagaagaatttcctcattctaaatgtattattggacaggcttgaagtccaggtcttaagtatggttacataagggacaacaataactatttgtttcaaattgtatctctttcaataaaacaatatctcagtggtttcagcagggagtacaaaatctgatctcttaaccctaaaattccaaccctggaaaaatggctcaccttcgccaaaacacacacacacacacacacacacacacacaactagagactgattttccacacaaaatttatgtacttattaaaaaggaatttactttataattatgtgcaagaattatcatggtgagaagtgaatgttggttttaatcattgccagtagatcctcccatcagccacataatcatattcactttatggaggaagcactattactccgtaccaagcatcttatataatatagctctttgttttcatccctgtgacaaaccatgtgagatggctgtgtgacccttgttttaaaaacaaggaaactgactgctggaaaggtaagtaacataattatccaagatctccaacctaacaaatgtcaaagtatgggagctgaccttgggcttttatgctcttgtccacaataatccagagcacccagaacatttatatctctaagaagttaagtttagaaaaatgcatctttttttgcatatatgtcaccaacttcgggtatttcttattacaagagacctttttgcttaaagattccaaatcaatcacccatcatttttctaacactataaattctaaatgcaaatgtcaactaagaaaggtctatgaacattttaaaaactcattttccccaaatccatatgagtctgaatgctgagaaattccacactaaaggtagaatacttaacaaaacaccaacatttcccttcagaaataacaaagggaaatataagtttgtgctcactttttcataatgtcatggcatgttaaaagatgaaaacctagtaacaaagtcaattaatagaatctacaatctttttaaaatattttagtagcttaagaagcatattaaaactagaacctaaatattaggctggaatcgtggtacatctttagctcttccagaatcatactcacagtggggctcacactgtattttaataagcttctaggtgggcccattcatctagcagcttaaaacctccccaggtgattccaatgtgaactccaggctgagaactgtcatagttgaaaaccactggactggcacatgagagcctgatttctgctgaatgtcctttctttgagctcttctcccccagtcctatgaaaagcatggtcgctgattaactcagagttaggtgaagaaaatcaaacttggagagataattataatagataccgtgatggttaattttgtgtgtcaacttgactaggctatggtgcccagttgtttggtcaaacatagcctccatgttgctgtgagggtatttttaaatgtaattaacatttaaatcagtagacttttagtaaattagattaccctccctaatgtagatgaggctcatacaatcagtcaaaatcttaagagcaaaggctaaggtttccagaagaggaaggaattctgcttcccaaatgcaacactgaaactctacctggctttccagcctgcctggcatgtgctgtagatttcagacaggactgcaacatcaactctttcctgaatttccaggctcccagcttgccttacagattgtgaacttgccagctcccataatcacatgagcgtattccttaaaataagtctctttctcactcgcattcatggtgtgtgtgtgtgtgtgtgtgtgtgtgtgtgtgtgtgtgtgtgtgtgtgtgtgtattctcttgtttcaatttctccaggggaccctaatgctagataccattatttaaacacagactatgtactagaaaccatgctaaattattcacatacattttctgagttagcctttacacaacccaattaaacagttgaataagcaagctataaagagaagatgtgaccagagatagggaagcttcctttagtggctgtggagagcaagcagtacagaagttagcactaggtgagccaagaaaaagccaaggacaaaagaagataaggtgttcattgaaaaaaacaaaagacaaaagggaaaggggaaacctatagatttaaaaatacagtgcccaccataggaaaccattcttctactttctgcttttattgctttgacttttatggacattacacttaagtggaatcacacaacacgtagtcttgcatctgactcctttaaagaagcataatgtttttgaagtttattcattttgtagcgtgcatcaatagatcactcctaaaacttcttgaatatagaagtggaatcatgtagtagtaggtctatgtttaaacttcaggaaactgtgaaagcagttttccaaagtggttgcaccattttatattcttaccagcaatgaaggttccacgttctccatatcaatgccaaaatttattattgctaactttttaaattataaacaattgagagtgtgtgtgtatgtgtgtgtgtgtttgtgtgtgtgcagtgtgtactatatagaggttgtttatatctcattgtgatttttttaaaatagagacagagtcttgctatgttgcccaggctggtcttgaactcctgggctcaagcaatccatctgattctgactcccaaaatgccaggataacaggtgtgagccaccatgcccggccctcgttgtgattttaatttgcatttgtctaatgactatttatgttgagcatattttcatgtgtttattagccatttgtagatcttcttcagtgaaatgtctattagaatctttgactattttaataaactttggatattggtacttattttaataaaccaactgtaaaatatgtttatgataaaattgtggaaatttaaacattcaaaggatacttgatattaaggatttattagggttgttttgggtttgataatgctattgcagttatgcttttagaaaaaaatctttaccttttaatgtgacacactgaataatttatagatgaaataatgtgaggtctgtgatttgctataaaataatccagaggaggtaggggaatttatataaaagattggccatatgttgacaactgatagttcttggagctgagaaaaggattcatggggactcataatactatgtttgaaatttccataataggtttttttgtttgtttgtttgagatgcagtctcgctctgtcacccaggctggagtgcagtggcatgatctcggctcactgcaacctccgcctcccaggttcaagcaattctcctgcctcagcctcccaagtaactgggactacaggtgtgtaccaccatgcccggctaattttttgtatttttagtagagacggggtttcaccgtgttagccaggatggtcttgatctcctgacctcgtgatctgcccacctctgcctcccaaagcgctaggattacaggcatgagccaccatgcccagcccacaataggttttaagaaataaaagctgacacaccgaatgcatgcattaacctacatatacactctctcaaaatctactaaatacaccgtaaagggattttttaaggcataagcaacaagaagaaaaggaatgggaatgaagacaacagcaacaaaactttggaagctagaaagtatatggatgaacatgaaccaacttgagaaacctgaatccccaaccagaagtggaaaaagccaagaaaacaacctgatttacacaacaaaaatcttcaaagggtttaggaataggtggcatcaggtacatctctggagataagtttgaaggtggaactgaacaccaaggaataactgaaagtagatttaagaaaatgaacctccagatattttactacactctacacagccaaccaaccacccctctcctactccagcaaatgactttggcttattttctgcagagtcaaagagaggttctctgcgatgaagaatccaagctacggttgagggtggggacaaaatactaaaatgaagaaaataagtaaaagtctacagattgaatatagagacttcttcctcagttcagctcccagaatgcttatagagaggctaaaagattagaagaatctggatgtccaacaagaaagactaaaagatgctgacattagaggaccccccaccatgtctgctcactccacagtaataagcttcacccacgcacacagagttcgcactagctttacagagcccaaccttttcttctgagtcattaattggtagagataacttattggggttcagggggttgatttaaaaattgagaactataggccgggtgcagtggctcacaactgtaatcctagcactttgggaggccgaggcgggcagatcacaaggtcaggagatcgagaccatcctggataacacagtgaaaccccgtctctactaaaaatacaaaaaaattagccgggtgtggtggcgggagcctgtagtcccagccactcaggaggctgaggcaggagaatggcatgaacccaggaggcagagcttgcagtgagccgagatcgcgccactgcactccagcctgggagacagagcgagactccatctcaaaaaaaaaaaaaaaaaaattgagaactacagaaaaagttacagatttatgactatatgaggaagtaatgaaaagccatttcatgaagcagtggtgaatcaagtttttactatatgttacctcttgggagaatagtttatactaaattacttgttttattaaaaaaagaaactatgccaaaaaagaaaaacaatataaatggtcaaatctaatatatttttggctttctttttgacaaactgtctgtaaaaatggtgtctattgttcccatatttatgaccatgtgtatccaatgtttagcacctatttataagcgagaacatgtgttatttggttttctgtttctgcgttaattcacttagaataatcgtttccagctgcaaccatgttgcctcaaaggatattattttgtccttttttatggctgtgtagtattccatggtgaatatataccacattttccttatccaatccaccactgacgggcacctgggttgatctcatgtcttcgctcctgtgaatagcactatgatggacatacggagcccaacttttaaatacaaatggacaaccaaggatcacaggacattttagaaaagccccaaacatgaaaaatgaaggctgaaaagtgaaaacctgaagagatttgtaaaataaacctaagtgttagataaactgacaaaatttcccagaaagtaaagtaaaaagatttttaaaggtacaaatggacgagcgcagtgactcacacctataatctcaccaatttgggaggtcaaggtgggaggattacttgagccctggagtttgagaccagcttgggcaacatagggagacccccatctcgaaagaaagaaaggaaagaaaggaaggaaggaaggaagggagggagggagggagggagggagggagggagggagggaaagaaaagaaaagaaaagaaaaaagaaaattagccaggtgtggtagtgcacgcctgtagtcccagctactcaggaggctgagacaggaggactgattgagtctgggaggtcaaggctgcagtgagccatggccatgccaccgcactccagcctgagcaacagagcgggaccctgtctcaaaaaaaaaaaaaaaaaaaaaacaaggtacaaatcgtgcttgatttaccatggttcaacttacaatttttcaactttaacttggtgcaaaagtgagaggccttcaacagaaactatacctatacaaccattttgtttcagtacactattcaataaattacataagatattccatactttattataaaatagtctttgtgttagattatttcaccccactctgtgatccaacaattcattatatccaacaatttattataaatatataataataataatatatccaacaatatattgttggatataataaatatccaacaatttattataaaataggctttgtgttagatgattttggctaatgtaagagttctgaacatgtttaaggtaggctagactgagctacaatagtcagtaggttaggtgtactgaatgcatttttgaattatgatgttttcagtttacaatgggtttatcaggacataatcccatcacaaatcaaggaccatttgtataatagttaattttatatgtcaatttggctgatccacagtgcccagatatttggtcaaacatgattctgcatgtttcttggcaaacatgtttttcgatgagattaacatttaaatctgtggattttgagtaaagctgattattctccataatgtgggcaggtctcatccaatcagtcaaagaccttagtagaacaaaaaatgaccacccagaagcaagaaggaattttgtcatcagactgaaatatgtattagtcagggttctccagagaaacagaaccaacgggatagagaaatctagaaaaataattactataagttacctagaggctgagaagtcccatgtggcgaaatctccacaaacacatgaaccaattccttaaaatcaatccatcaacccccaacccgtgtgtgtgtgtgtgtcctttcgattctatttctctggagaaccttagtaatataggatagtaagaaataaagcatttaaaaaaggaaagtcaaagccaggaggtcaacatcttaacaggatatccagaaagacagaacagaaaaaacaaacttgactaaatcaaataaataattcaaaaaactaccccagaactgaagaacatgactttctggattgaaagggcccacagagtaccaaccacaaaaaaaacagaaatagatccacatgaactacctgcttaacacaccagcacacctccctctaagaaggccaaaacccttactcagagtaattggcctacaatttcagcctcttttctatggagtccttcggttctggaaaatactcctgagattgatgaatagaaaagaaacaagagcaggcaggactctgggccatctgcccctgcttcatttatagaagccctgcttttacgtttcatattctagatttttggataagtttttttttactttgcatttttgcattggctattttttaattgtatctctttaaggtatataacatgatgttttgatatatatacacatagtgaaatgattactgtaatcaagccaattaacatatccatcatctcacactgttactctttgtatgtgtgtggtacaagtacctaaaatctactctcttagcacatttccagtatacaatattattaactacagtcctcatgctatacagtaaatctctgtgcttacgtgtcctacataactgaaattttatactctcgttgacctccatctgcccatttctcccacacccttcattcctggtaaccactcttctattctctgtttccatgtacttgaagtttcatttcgttttgttttgtttagatcctacaaataagtgagatcatatagtatttttctatgtttggcttatttcacttagtatcatgtcctctacttccattcatgttgttacaaatggcagtaactccttctttaaggctgaataatactccattgtgaatagagacaccacaatttctttatccattcatctatcaatggacacttgggttgtttcattatcttggatattgtgaagaaaacctctttctttttgctctttaaatatataaagagccatctctggtgcaaattccaaaagaaccgcccatgaccaagactattcctgctggatcacacctcatcctttccctagctcccaacaatgacatctagaatattatactgaattacatttcaggcctttgtggtctagcctagaacttaaatgtgccttaagatccaaacaagcagcttttaaacaaacttttggaaaatgctctctattcataaatggaagctctctgtgcctacggaatagaagcaaattcatttattaatagtccctaggtcactcataattagtgcaaaactagtctgttaactaggcaacccctgaggcttcaggaagtaattcatttatgtgtttgtttttcttcaatatttatagttgttgtcttgcacaaaaatctatctcacagagatgtctgaaatctcttcactggtcattaactactctgataaacattatttacttttctcttaaaacatataagagaactagagaaattctgaaagtaaatgagatagcacaaaaaaaagatgaaagaacactgaagataactttggtatattttataaatcttcccagagtctcggcttatagctgggtttaatgccttgacacatacatatttatcaaaattggcagagtaataaaatcaggtgagataaaaactgacatgaacactacaaatacaaacttactatagcttttttcaaaattatattcaaaatggaagcatctaactgaaaattgttactttcattgtacacaaaatgagtatatgtgtatatgggtatatgtgtgtatctctcaaatgcatcatactagcaaatttgagcaatgtttttcacattctcatttaaacataactaaagtcatcctcagtggctacctaatcagcctaattactctgggaattactattaaactagtgaaagccacacaaaagattggtgtaaactattccagattcaaataaaacatatcatttctatttttccattcacagctgccgaggaacaactacacagtcagcagctactagaataaaatcttacagtccattcaaatctaaaaagcaacactgtgcttatttaacaaacaagtatgctatttatctaccatactagtgcttagaacaaggacggggagccattttggctataaagtttagacagcttcaagatgaaggtctgagctaagccttaaaagataggtagggatatagaaaggagagggaagaggagttctaaacgaggacataaagtttgaaaattaaaagttaaaaaaaaaaaaaaaaaccctgaaaactaccatccagcaaacagttttcccaaatgcagagttcttagaagagaatgatgggaaataagattaagtaggtgaaacttacactgagaaataacagaaatatttagatagaagtacaatgatggaaggcataattttttcagtgtacatgtgcatattaaatagcaacacatataaagctcttagcacagtatctggcccataaggctaaacaaatatttgctattattgttgttattattattaactgaaaatttcaaatagtattttctgtagtttggacaactagtaaatatgactaccccgatttttaaaatctagaattaaacatttctatgtacttcttaattttatatacatgatctcaccacaaagccctcaatattactcaaaaggcacatctttatttccctgtacttcaaatcaatttctatctaaacagaaattcagcttggtctttccccaggcaatgataaccttctctgacactctctaatgctgatgtcctccaaacaggactttctgtcctccaaaaagaaaaaaccttccccaaggaacagcaagaaagaaggaagctttataatagatgaatttataggcaagtctgtctcttatctaacttctgtgagtgtccagccctgatcctgtgtctttggtttaaaagaaaaaaagccctgggtaagccaagctcagccctaggcatcctcctcttcttcctattttggccctggcttccatgaccctatctgttttctgtaatttgctacatataatgggtaaatatggaacaacgatgaagaaagcaaagattggaggggggaggttgccaaactgctctccgctttagccccgactttgatataagaaggcaggagagccaaggattaatatcagaggtggtttttcatttttcataacatttcagagcctgaaagactgtaacaagatggtgatgatgatgatgatgatgatgacgacaacaacaacaacatttcacatttatttaggctttcactacataatcgcaaaaacactatctcatattaacaagaataacagctacctggagatcaatgagtctagtcctctcattttataggttagacaacttaatgaagtcagagagattaataactttgccaagactacaaattagtggcattggtgataataacagtgatgataataatgatggtgatggtggcagtgattacgttaataacccactaaattctttgtgtgccttgtctcatttaatccttacagcagccctaggagggaagtactatatttatcttaattttaagctgaagcaactaagaatttaaaagatcaaaaaacttgcccaaagtcacacagcaaataagtggcagaactgagattcaaaaagcagatggactcaaaaatctgtcaagttaaaacactaaactacacttcctgtagttaaaattacaactcgattcttctgactctgatcctagtttaatattgtttccctcatagcctgtctcctaaatttagtgaggtatgtgttgaaatagaaatctaatacgtattgcatttattttctaatatattatctgttacccctacaagtttaatgttacagaatatagatccatctctagctgtaaaaatatactaatatatattattaagtaattagcaatagtattcattttatcaatatgacatttaatcaattttagtttttataagtcagatgcacatagtttatttcaagaggaaaaaaagtcatctcactgttatattcttgcagaagattgccctgtcctaaaatcaggattatttgtagacaatacaaagcagctaaactagcttctcttagaatttccactgtaggaaataaataacaatatacactaagttaaaaataataatgcccttgttatttataatctaccctcagggaattttaaagcacttttcatgtcgtaacagtcttaaaatgtttccaggatatggattggcaaaccaaagtactgtaaaaagaattgtgattttttttttttcttttagatggaatctcgctttgtcgcccaggctggagtgcagtggcacgatctcggctcactgcaacctccgcttcccgggttcaagcgattctcctgcctcagcctcccaagtagctgggactacaggcacctgccatcatgcccggctaatttttgtacttttagtagagatggggttgcaccatgttgaccaggctggtctcaaactcctgacctcaggtgatccacctgccttggcctcccaaagtgctgggataataggcatgagccaccactcctggcataacagtgatctaaaaatcttctatatggccatgtgctgtggctcacgcctgtaatcccagcactttgggaggccgaggcaggtggatcacaaggtcaggtgttcgagaacagcctggctaccatggcaaaaccctgtctctactaaaaatacaaaaattagccaggtatggttgcaggtgcctgtagtcccagctactcaggaggctgaggcaggagaatcacttgaacccgggaggcggaggttgcagtgagccaagatagtgccactgcactccagcctgggcgacagagtgagactccatctcaaaaaaaaaaaaaaaaaaaaaaactatgtgaagtagctccttgcacacaatagtgacaaaaatatttagcatttattcaaagagctataatttccagaactctttcaattcttaccctaatcctgagaagcaagcagggaagattacattatccccacattaaagttaaggaagaactatgattcataatggatacttgtctcagccaaaatcacagtcaccaagaggcagagccaggattagaaccttggtcttctgactcgtgagtcctatatacttgctactctacttgatctttatttcttatataaaagaatgttcagttaatgtttgacaaatgaacgtatgcaatgcatgagcaaatcacatttcatcagaaagaaatgctgaatttctaaatttcagaccagcattttgccattatataattttttctctgtaactatactttttgtttctgaagaatgaggctgtcccctcaacaagtataattatcctctagaaaagcaaattgtctttgagctgataagctgataaacagctaacacacaaaatcactaaatttttctagataaaaatcacgagttaaaaaaatagatatatcttcttagaaatataccaagaaaaccaaatgctataacttttaaccctagtttatagcatagctaaagaacaattactatataaactagacacagttttggaatgaatgaatgaagactcatttataccaagaaggaagaaaagaatcacaacacagttcacccatgatttcacatctattaagtagaaaatattatcatattctcacaactgtcagcctgtgctgccagacttcacatttagcaattatctcaacgccagctgtccccacaatttcgtttcaaatttaatatgccctagaaaatattacatttcaaaatttctagcaatttgcaaaagatagagacagaagaggcagcctctgtagcaaaggcatgtgtaggctctctgcacactgtgggaacacactggaatcctatagtggacatttgttatgtgccccccaaccctctccaggattattctgggtcttctggtacaactccaaaacctcatttagataacacccctcccccattctcagtccatgtagactggatgaggtctccttactccactcaacaaagccaaaaatgaacataagactgctgatgccaacatcagtgctttctactacattatgcttcatattacagtgacatttattgttttgtctgcctaacacaacattcccttcttatggaatggcaactaatggctatgtgatcaagctgcctgggtttgaaacctgttcccaccacttcctacccatgtgacttgatccatttatttaactgctctaagcctccatttcctcatctgtaaaacaaagattcattcacatattcaacaaatatttattgaacacttattatgatccatgcttgtgcaagtgctgagataagaatagtgaataagatagaaaaggtcaatatcctcatggagctcagatatggcagtaaacaacaataaaccaacaagagaggtgcagattataagcgccataaaagaaataaataatgggagaagatagtaaaagagtgattctagatccacttacatagaatgtgcagaatttcaggataaagaggctttcagtataaagcctctctgaggaggtgacattttagctgaaatataaaaagaaagaataagccaaccactcaaagagaactggaagatcattccaggaagagggaaagccagaggaagaaaagagcttggcacaaaaggacatctagataactgaagcatggcaagtgagaagggggtaaaataacacaagacgacatcagaaagctaaacagaagccagactgtgctgagccttgcaggtatgggaagaaattgagatttcattctaggagcgagcaacggaaatccattgaagtgctttatttaaagctttgtgtttttaaaatgttattccagctactatggaaaggatggatatggaaaagaagagtcatctattcaatatagttaagaggatggatggaagagggaaagaaggaaggaatcagggatgatttctaggttacttgggttgagcagctgtgtatatggtgatctattgattgagactacaaagattaggcaaaagtcagggttcaagaattattacatttgagatgcctatcagatcctcaaaatagctgttatacacttttttttttttttttgagacagagtctcactctgtcatccaggctggaatgcagcggcaccatctcggctcattgcaacctccacctcctgggttaaagcaattctcctgtctcagcctcccaagcagctgggactacaggcatgcaccaccacgcccggctaattgttgttgttgttgttgctgttgttgtttttagagacagggttcgccatgttagccaggctggtctcaaactcttgacctcaagtgatccaccctcctcggcctcccaaaatgctgggacatgagccaccatgcccagccctgtgatacatattaaatgaaataatctatgtaaaaagcacaatgcctaatgcagagtaaacattcaataaatgttagctattattcatgttttgagaaaaagaggaaagttccttccttggtctacccatgtggttttggtaatgactgatgactttatcttatcccatgacccagctagggcattggacaactaactggtctagatgaaaccaacaagaatcacactctcttagctgtggtgattggtccatcactcaagccacaccaacttaagttcttccctatgattttcaaactagaagctgaaagggaagttccccttcctcttcagtagggaccctgtaagagtccagggatgctgatggtaaagttcctacttctaggagaaatgccctctgtaattggagggaataaggctgatacccagagagaagcacagatgagagacagagtactagaggcagagagtgcttatttctagtaattctagggtagtgctgtccaatagaagcataatacaagccacatatgaaacactaaaaatagacaggtaaagttaattttaataatacattgtatttaaaccaatgtatccaaaatagtatcatggtaatatgcactcaatatacaaagttgccaaataagaatgatacaatggactttggggactccggaggaaaaatgggagggggggagagggataaaagactatgaatgtggtgcagtgtatactgctcgggcgatgggtgcaccaaaacctcacagatcacactaaagagcttactcatataacctaataccacctgtaccacaataacttatagaaaaattaaaaataaaaaaaaataaaaagttgccaagtgttcaaaacccagtgtgtatggtaaatttgaactcagactagccatatttcaagtgatcaagagcgatatatgactagtggctactgtgttggatagcactaccaacactacctgggctctacccaggccctttgcaggccataagccaatgcatgcccttgtaggatttcattaatttaagttggatttgtgtctcttatcccgagagtccttaatttacctaaaaacattatttcacttattccatttacatctgaaaccctaataattctttttttttttttttagatggattcttgctctgtcacccaggctggagtgcaatggcatgatctcagctcactgcaacctccacctcctggattcaagataatctcctgcctcagcctcccaagtagctgggattacaggcatgtgccaccatgcctcagtaatttttgtatttttagtagaagaggggtttcaccatgttggccatgctggtctcaaatgcctgacctcaggtgatccgcctgcctcagcctcccacactgctgggattacagacatgagccactgtgcccagcctaatcatttttttagaaatcacacacagtacattatattctgaaaattgattcaccaattcttattagcataaggactatcacctatttccctacttgagtgccaactcccacttcacatatgcactacagttaagactcattagacctctgtattccagccttgattagcacaagaaaccataatggagcatctgcaaacaagaatcaaaggtactacaagtgataactctgattgagttgatctgaggtggaatctgggactccatttttttaaatgttgtcctagtaattttgataatcacccagattcaaaactaccgagttggatcacttactaaatctaaatagcaacttctgccccttatttaccttttctattgttacaagtatttcctctgttgtatttactgaagcgcatactatattcacctttgtatacttaattcctaaccccttaatggatatacttcaaatattcaataaatatttgttgaactaaaagaaaaacttaaagtggacttttaatatgatgctatttccaatatgatatctaaaatagtccagagaagtagtgggagataataagagtactaagtttaggtaatggcctatctctccttctttctgttctaattttaattagctctctgctagtctgaattgagggtaaagggagttaattgttggattactctgactacagttacattaaaaagaaagtgccctgtggccatattaagtgccatgttgtacccaaatgtccacctgtagttagataattttgatttaattgacttcactcacatccagagaccatggaagggagtggaagtttggtcaattaaaaatcaagcattaagaatgccaactgattcctcctgagtgagaattagagaaaaggaattctaggtctgtgggcacagggaaagacataccaaagcattcataaatggctcttggttcctcacctccttcttctcttccacacacacattctaggaggttcaataaagtgctgtaatgtgttttgcacacagaaggtactcaacaaagttgtatcagttgctggggccataaccaagtattacaggctgggaggcttaaacaacagaaatttgttttctcacaattctaaaggccagaagtctgagatcaaagcattcgagtggttagttcttgctgaggcctctcaatctggcatgcagatagctgctttcttcctgagtcttcacagggttttccctctgtgtttgtcaatgtcctaatctcctcttcttatagagataccagtcatattggattagagcccaccctaataaccccattttaacttaattacctctttaaagaccctgtctccaaatacagtcacattataaggtagatggggttaggagagcaacatatgaatttaagaagacataattcagcccataacaagtaccgtctaggtaaccactctaacagaggttagatgaatccaagaatagctgaatcttgaagaggtcatatagagttatttggtttcagggatatgttaaacatgaaagatctaaaccagcggtttcaaacactactgttcaacagaatcgattatggggtatgttacaaattatgggtgttctggccacactcagaaattcttaggagtagaccaggcatctgtatgtttgcagcctggaacaaagtctggtattgaccctaaaagacatgtcaacctagacagccagcaatgaggcaagaagcaggactggcaatgaagaggaaaagacctcacgtgaataatgtagtgatctgtatcgctacattctcttcatcattaagtctctgttacccaaaattcactctaataccatattactctctttgtgactttgtccaaacaaagtcttcccaaagacgtaatgcacaatgagaagtctatgcttatgatatttttcagaggagggctggttagaatcacaaatgatgatcatttacttcacacctaatataactcattctccgctgaacggaatttggttgattgactgatttgtttaggccaatggattcaaggaagtgggccatattcatctcatcttcttctcctttaagctgcctctgggacaagttgacacacattttcaccactctctagtctcatggttgattaataatatccgtataattatatttcatcctatcattaaacagtactggattcaaagtaaaactcagtgaaataatttggcacaactgcttttaaaaattatatttttgtattttctccttcatatgcttctttattctatctctgccttccattcaacaaatatttattgtagtgccgggagtatgggaatataacaataaataaaacatagcctctgcccttcagaaaagtaaagtctagaaaagaaaaaaagatgtgtaaacaaataaccacaagagaatgtgccatattataacaaagatacacataaggtcccatggagcacagagtagagaactaacattgcctgaaggcagagcttacacacaaactgaaggatacagtcaagtatccaggcaaggacacaggacaagaacaggcattaaagcaagaaaatgcaaggcaagtttagggaacagaaaatactcatgatggctctaacaaaaggcttgtaaggttgggactcatggtgggccttccatgctacactaaataaccagcactgtcaggggaagtcactgatagttttttaagcaccatcagttctgtgtttaatttcccccaggcataaaattttcctgaggctgtctgctgctccccactccccagcgtgcgcccctcttccacagccccatgccgcctgtgctgtagcaatcagaagtacttactgttctctaaatatgccaggcatgttctcactgactgctaatgtcaaaagcatgacttgaaaaacatctaaatgcatgatcagaccagtgatagcaaccctatggtggagttttcaacagttaataaggggagcaatattgaatcattccagttctctatattttgtcatttgctgttcctgctgcttcatggaaaagggttatattttctctgtaaatagaacttgatatatcttcataaccgtcagcagggatggacactgtgctacttcccagcaaaaggtgaatgaaaagtgatagcagttaaaatggtgttctttgctgtttctctgttttgttttcatactcttcttttaaaatcagactgtaattttaacaaggtggcaggtaaagcattcctttttgcttttaatgctgcctggaaataatttgttttctcctctccagagaaattcttaaaaaaaaaaaaaaaaaaaaaaaaaactgtaaaaacctgactgttctgatacaaaccttgttaataggatgttcaccttaaaactaacccaaaagaggaacaagtaaagcaacatgataacaaatcacagaattttagaaaggactaagagcaaatgtagtggtgtggttaaaagctatggttcctttgaagctcaaattaagaagaacctgctagtactgatcatctagcatcctaagtgggaacatagcaaatagacatagaattataaccctaagagttgaaatcagaataatagcaccaatgaactcctcaaatcattttttaaaggaatatatttgtgaggcaatgcaagtgaaaattacataatatacagttactaaattcctgagagttctatttttgtttattcaatatctactaatataaggacaaaaatcattgctaatgatcaaaagagcatagcaatcattatcaaattaagaggccaggcatggtggctcatacctgtaatcccagcaatttgggaggctgaggctggcagatcgcttgagctcaaaagttggagaccagccagggcaacatagtaaaacccatctctacaaaaaaatataaaaattagccaggcgtggtgatgtgcacccattgtcccagctacttgagagtctgaggtgagagaatcacccaagcccggggaagtcaaggctgaagtgaaccatgatcacgccactgcactccagcctgagcgacagaaagaaaccctctccaaaagaaaagaaagaaaaattaattaagatgtgattcaatacattttttccaattctttaagttattaagaagccaatgtcaatctctcatccactgcaggaatctcctagtttccctaatatacaacttcggtctctgctgaaatattaccttttttatcgtaaatacttaaggtatacaacatgatgttttgttatacatatacatagtgaaatcattatcacagtcaaacaaattaacatatctgtcatctcagataccttttttccccctttggtgataatctactctcttagcaaatttctagtatacgatgtgatatcattctgtacattggatctctagacatgctgtacattggatctctagacattcatgctacataattacaactttgtaccttttgacatacatctccccattcctgtccctccctccccaccccaggccctagtaaccaccattctactctgtgtctatatattcaactttttttttagattctgcacataagtgagatcatgcagtgtttttctttctgtgcctggctttttcactcaggatactgtcctccaggtttatccatgttctctcaaatagcaagatctccttttttaaggctggacaatattccatcgtgtgtgtgtgtgtgtgtgtgtgtgtgtgtgtgtgtgtgtgtgtgtgtgtaccaccatttctctatccattcatccatcaacaaatgcctaggttgtttccattctggaccatggtagatactgctgcaataaacatgggagctcagatatcttgacaaggtgctgacttcatttccgttggatacatacccacaagagggactgattgctgagttatattgtagtcttatttttaattttttgaggaacctccactcagttttccatagtggctgcactaatttacatacaaaagtttcctttcctccacagtctcaccaacacatctctttttggtttatttctgaactctctattttattccatctgtctatgtgtctgtttttatgccagtaccatactatttttccatattataactttgtaatatagtttgaaatcaggaagtgtgatgcctcaaactttgtttttctttctcaagattgctttgcctatttggggtcttttatgtttccatacaaatattttctatttctgtaaaatattacctttgcctcttcttttcctttcttcccatgtcatagttccctttctttttcttccctcttctctctatgcttctcattctagatcacatttgggtaatgttaggtacatgtatatagtgactatttctcctggaagatgatttagactacaactacaactataatcacttagaaaagtgtagaattcctctgtccacctagaatagagctgaatttgttcatattccattccaaacacagcattctaggaaactatgaagtattctgcaagctgtaaaaagatccatataatagaatattatttgccattaaaaaggaataaagggccagacgtggtggctcacgcctgtaatcccagcactttgggaggctgaggtcaggagttcaagaacagcctggccaacatggggaaaccccttctctactaaaaatacaaaaattagctgggcatggtgccccgtgcctgtaatcccagctacttgggaagctgaggcaggagaactgcttgaaccagggaggcggaggtcgcagtgagccgagatcgcaccactgcattccagcctgggctacagggcaagactccatctcaaaaaaaaaaaaaaaaaaaaaaagaggaataaagtacagatacatgcaataacatgggtgaattctgaaaacatgctaagtgaaagaagacagtcatataggccacacattgtatgattccacttatatgaattgtacagaataggcaaatctattgaaacagaaagtagattagtaattgtctacactggggagatgggaggaatgggaagtgactgctaataagtacagtggcttctttttagagcgatgaacatattctaaaattagactgtggtagtggtttcacaactctgttaatatattaaaaaccatccaattaaaaactttaaataggtgaacattatgagaattatatctcaataaagctgtttaaaaacatgtatctaacgcaacagtctatgtgtacacacccataatatatgcatatatatacatactcatttacagagagttctgaattatcagcctgcagtttatccactgaaattttaaaattcaaaatttcttacttccttgattgtatgagaatggtaataataacaataatgacagcaataataatatcaagtactcatttagttcatactatgtgccagctattgtgctaaaaatacgtaatcttattaaaaccttacaaagtcaccaaataatagagtctgttactaaccattttaacatattattttttataatcctcacaacaagaactacagtttttctcaatttatgagaaaactgagatttagggtggtgaaataaatcattctcggttttacagctagtagttggcagagcaatgatttaaactccggtcactgcactctgctgccacttgagctatccctctgtaagggcaattgagtctcagtgagctaaaagaatcttacattacttttgcagacaggcatctaacagagtaggaaaaatcccagaaccaaaagctgaaacccagaccgcagtctgagtcatgatacaaactaaccaggccagccaaattccaatcctctcatctacaaacatggaaattggaatagaaatttttcaaggtcctatcagcttaaaagtccatttgtccaagaaaaacttacttaaaaatctgagtcttcagtccaaaataaacttgccagaagaaatgctttctttattttctgccctatgagtttacgactattattaggttgtaaaaatattaagtataactggaaactgaaagcataattaacatttacttataaagttcgatatcacccattagcaatataacacataatgatttattaactttttactataaaaacttttaaacatattcaaaagtagacagaatagtattaaaaaacccaacgtactcatcatacacctttaaaaatcgtcaactcatggtcaaatttgttccatctatataccctcccactttgaagaaaatccatggcatcataacatttctgtaaatatttcagtatccatgtgtaaaagataagggttcccttcttaaaagtataatcatgataccatcatgacacctaaaaatattaacaataatatcttaatatgacaaacttggaaaatacatttagatatataaatggcaataaataatacagatttaagtaccactttcactgatattaaaagataaacctaggcacattaaaattttaaagagtttatttgagcattcagtgattcatgaattaggcagcaccagactgcaagtgatttgggctccaccaaaggcgtgcaagggaaaacttttataaggtgtctgtggaagcaggacagagaaaatgtttgatttattaaagtggagagtccctacttagaggtaattggcagtgtctggtaaagactctagatagagattcactggtgctttctgatttgttaaacttaagtttcatttcactgttttacagtgtgtttactgtttacagtgagtttggtttcagtttgcttacataggaacccaaagcactacctaatggtttcccaatcaatttttttttttttttgagacagagtctcactctgttgcccaggctggagtgcagtggcataatctccactcactgcaacctctgcctcccgggttcaagtgattctcatgcctcagcctcccaagtagctgggattacaggcacacaccaccacgcctggctaatttttatatttttagtagagacagggtttcaccgtgttggccaggctggtctggaactcccggccttaagcaatctgcccgtttcagcctcccaaagtactgggattacaggcgtgagccactgcacctggccccagttaatttttttaacactgacaaattttactttgagtgttaaggctatctgtatattcaaattttccagactattatttctatttgaatacattatttatatatataatctattatatctatacctaatgtctctgtactctattcatgaaatgtcatatggcactatactgaatgtgtccatagaagtagagtactaaacattctatatatactgagcttattagttttgtttactcattgagcttgcctggtattgaaaagaaattaaattagttaggcatggtttgtttgtgattaacctttcctgtcttccacagttcaatttatcatcctcttcgtgataccaaatgactactttatgaattgttccacaaatttgccagctattattcacgagctacatattttatccaactgaagtgtttattctgtgacccttattttcatataactctctataaccattttgcttctaccatacttactctcacattccttccctagcttgccttgccctccaaaacaaaaaagcttccaccatgaaattactaattgatattctgccttataaactttgccttgaaagattcctttgaaaaattaatttcatttcctcgatctagccaatgataaaataatgatgacagcaaacagaagtagaaacagcataattttttaaaaaaggaaacatcaaattttgtattgaaaatttacatcagcatttcactagtgaacagacatttcctctgagaaagagtgataattaccatttgcacctcatgtaaggattttcctgaggcctaagaaagctataaataatatagtttcttttgaaataaagaaaaaaaatttaattttctttcatcacgctaacaagaagtaaaataggttgcaaataatggtgtagtaaatggattaaagagattagcttcaaaataactgcactgcaggacctaaatgctgaacttgggttatccaggctaaataaaggccagtcatcatcttatttttatagttcaatcataagttagggcttatgggagtaacgcaattaagaaaatatatatatttgggggagttggaaaagtttggaaaatttcaaaaatcaaatcacatttcaaatggattaggagaactcactaattaaaggtggatagatttcatactgttaaaaaaaaaactcaaacaagtaaaaaaaaatttatgattaaccaccaatacaaacaataggcaaatttattagtttctctgctcttgctttacaactgtaacctttataacaaaccctgttagaccttgtaggagaccctgttaatgcccacaccatatccccctgacttgtctgtgagttctcttccactgctgtggatagtcatgctgatgctgacagcttcccacctaaaggacccacagttctttctccattttctctttattcttcctggaaccaccttgcacatacactacccatgcctaagtccttacaccagggtctgcttttggggaaaaccctaataagactgttggtaatagaaatagcactagaaagcagaccttcagaatgagattctggaattgcattacttgctggtcagagggcagcaaggatccaatttctagtgataagtgagtggtgataacccctaacaggctacagcagtataatgcccaaaatttttaactgaggtggactgtaatgtgttacaggaaggaggaagtacaagcttatataatagctctaatacttgaaagacatgtggtaatcaaaacaaagattttggagtatgtgttaactactcgagaagctttgaagaatgagaatggcaggcttgggtaagccatctatcaattcagggcatgctgtaaaagtcagaaaaactccatgtcagtatttaaaatgaaccttatctctggcactcagctaacatactatactgaaatcaggcctaagatttgatgaaggagcttagctacaaagacaactaaatgcacagccccagcaggtctcccatcagggctctgatagggaaagggggagggtggtgatgcatgggagggtgatatttaggggggtgtacatgagaccactaaacactcaaatctgctgaaacctctgggccggcagaatccaccctcatccctttcataaaggtaagccacctctaattgcatggagacctggcaaaggacatacctgacgggggtgccttcctccagatctgcccttcatctttcattgcctctagaccagtaactagggtcaggtcctactgataaaagctccaactgtaaggcgcagtggctcacacctgtaatcccagcactttggtaggctgaggcgggtggatcacctgagatcaggagttcaagaccaacttgaccaacatggtgaaacctcatctctactaaaaatacaaaattatctgggcatggtgatgcatgcctgtaatcctagctacttgggaggctgaggcaagagaatcacttgaactcgcgaggcggaggttgcagtgagctgaggtcgcaccattgcactccagcatgggcaacaagaacaaaaagctgtctcaaaaaaaaaaaaaaaaaagctccaactgtgaagggcacaccttcacattggtgggaagaatatgggaagaaatcacctattcaccgaaaaagtcagctgagcctatctgacatgtgtcattagaactgagagcacacataaggacgtggatgttgagggtgctgagctgaggcatggggaaagaatgctagatagaggagagtgctttcatatggaggcaatctctggtgattcataatttaatttgtagcaaggaaatcataagtaggtcctaaaacactaatgggatgtcaatgtgactgacaggattccaaaataacaggcatcagaggtggcacttagccatcagaagcaaggtgaatgcacgccattaaaggtagtaaggtcagagcagtaaccagagagcttgacctgcaggggtctgtggcaatggttgataagtcattagccattttgtttatagaagcaaaagagatgggtaatgtatttgttgctagggctgctgtcacgaactaagtgacttaaacaagagaaatttaccgtctcacagttttgaaggccagaagtccaagatcaagacattgttggttccttttaagggctgggtgaatctgttccatgactctctcctatcttctggtggttttctggcattctgttgcgttcattaacttatagaagcatcaccccaatctctgccttcatcttcacatgacattctccttgtgtacatttctgtgtcaatattttctttttgataagaataccagccacattggattaggggcacaacctaccccagtatgatctcatggttactcattacacaattcaacctatgacaagtagttaataaggttaattttttatttatatttgcaaagaagaccaagaactaaacagaagatcgatgttccttttctggatctaaggcagttctcagacccagagcccatcaaggggaggctaagtcctcttgagcgaaagagctaatgtttctccaataattctttaaggggaagtgctgccatataacagagtatatggcaccatatgccagtatatacactggtgaaagtggaatacccaaacctttcagggctattggatataggctctaagctgacacttataccagggtatccaaaatagctttgtggtctcccagttagagtaagagcatttggaagccagataataaatggagccctgactcaagtccatctcaccatcagcccaatgggtctccagacccaccaactggtcacgtacctggtccctgagtacataattgagatggatatacttagaagcagctagaatccaaacactggttctctgaactatgaaacaagagccattataatagaaagggacaaagaaagcccctggtatcacttctgctctgtccctggcccaaataataaatcagaaagaatattttggccaggtggaataacaatttgtgccaccctcagaatgcttcctgcaaaaaaaccatacggctcatggatgagtcagctaaatacgttggtgcaagaggaaaactactgtcacactatagcccaaggcaaggatgaactactgcaatgttactcaaagtgtaatccatagactagtgccaattcataaatttatttttgtaagtcgacaaaataattattaaaagtgagagtacatatttggaaacattagagcaatttgacattgctgtaataactgtagttttatattttacaaaaagatcactcatgttgaactgaaaacaaacccatatatagttccttcacatgatcagtttgagtagcactgttctaaaggacagtggtgaaaggaaatccatcaggcagagcttcataactttacatgaagaaagaagtggtttgaggtgagaacaatatcaattgttgggcaggggctagtggttctgctaattgatcagatgcctggaagaagcaatacttcatgatcagatacaaggaggtctgagaaggaggcatgtggatgaccctataggtgtgaatacctaacaaagcatctatagtagaggcagcattgaacaaccagatggaaaagatgacccatccaatgaatgtcagccaatctttgtcctcagccatcacaatggttgcacagtggacatggaaactgactagccataatgtcagggatggaggctatgcatgggcataaaagcatatactccctctcaccaagggtaatctagctattgacagtgctgaatgtctgaccaataagtactggcccaaagtggcccctcaatacagaaccatccctcaaaaaagccaatcagacatttgtggcaggttgattacatcaaattcctttccaccttggaaggcacagcaattcatcctcaatgggcctgatggttattcaaacatgcttttgccttttttgcctctgccaggtcatatttactagcataggatccaccagtctcaccttttatggccattctagcactccatcaagctgatgaaccactagcattccatcaagctgatggccaaaaggctcagctttagaataactgtctaaaggattggtgccccatcctcttaaacagaggtccccaatctccagcctgcagagaggtaactctccatggcctgtgaggaaccaggctgcacagcaggaggtgagcagcaaggaagcaagcattatcgcctgagcgctgtctcttgacagatcaggagtggcattagattctcataggaggtgaactctactgtgaactatgcatgcaagggctctaggttgcatgctccttatgagaatctaatgcctaaggcagaacaatttcatcctgaaaccaaccactctccccatcccagcctcccacctctgtccatggaaaaattgacttccacaaaagcagtctctggtgccaaaaaggttggaactgctgctctacagcgcagtagatgagtcaaaccaatgatcattacacgatgttctgtccccttagcatgggtgtgggaactaaggggtagaagtagaattggcagcactcaccacttaacccacttgggaaatttgtccatcctcagtagccaagttgggtaatttgtacttcccgttctctcaacttcagactctgtgggatgtgataccttaacccctatgagtggaacactttcaccagagagtaaattactttcacccaaaccctttattttggtgcctgatttaaaagagaatctgagttaactttaacacagttagatacaattattatcaccttatattgaggaatgaggcacgaggaagtttaagtggaccagggtcacacagctagtaagtgatagaatcagaacttgaccctgggcagtctcatctagagtccttgctttcaacctctactctaaattatctgtttttaaagttcatgtttttgtatttagttgtcttggagcaaagcattcctatattattttatgtttctaaggcaggtgtggctagcacctctataattaaaataaagttcaattaaatctgaacaagtattatttaatatagttttttattattttaatacaggtttcaatgtaatcagacagtaacaatgtctagctctgtcttcatttagcatgtatctataaacacgctccttaaaaacatacctaaacacacacacaaaaaaagatgtctttataacaaattttcacaagttatgcatttttgaacaacagttaacaggataagttcaaggtaacagttgccagtgattttcatccctaggaagtaggtaaatcaaccaggctaggagttttcaaaaataaacataaactcctttgtactagctaatccttatcatttagcatcacctgtccttcagctggccctatgcttgaggcatcagaatgaagccctgggaactagtattcaaatcacaattattttaaagtttacaatgggcaatttcctaaaagtgatatgatagaaagagtatgaattctggagtcagacaatcccagttttgcaacttacctgctatgtggcctaggacaagttatttaacttttggatcttcagttttccaatatatagaatgtggaagaaaaaaagattgaagtatgcaaagtgcctagtgtaccatctagcatccagcagctacttaataagtaatagtttccttcttcataggtattattaattaattcatgtttacataattacttgcaactaaaataaacaataaataatgtagaaaatcctaagggtcttataagtttagatggaaataaattggaagcttgcataaacagattaaaacacagattcacaagaagaggaaataacaataatagattagaaagcaggtagacccagccataggaaagaaaacttaaatactactcagcaatatctccaggataccatcagaactgttttggtcaccccataggggtagacatggatatccactgctataattttgcactgtactaacatggtagcctctagccacaggtggcaaattgagcacttgaaatatagctagcccaaattgaaatgtgctgcagagttaaaaaaaaaaaaaaacctggatttcaaaaacttggcatgaaaaaatatataaaatatctcattaaaaatgtttagattgattacatattgaaataatatttggatttattgtgttaaagaaaacattgttagatttaacttcatttccctctttttactttctttatggtggccactagaaattttaaatttacataagtggtttgcattttatttccactggacagcactaatgtgaggtcctaatttaacttgaacagcactgatgtagagtcctcattcttaggctcccatgttcttccctcccagtcttccattctttagcaaagacttagcactacagtaacaacaattttcattcatgtccctgtatgagggccccactatcctggatgcaacacacggatgatttgccacaaatagtctttaaatgatttataaaatatataggaatgaataagcggataaataactcccagcgaaaaatgtccctcaaggacaatattcacataggcaagactctgtggtactttctaacacactttaaaaggaacattattttaatatgcactatccattcacgacattcaagacaagtgaaggttagctgtctactagaaaaaataaaattttaaacttgaggcatttattcatataatcaagagtctaggaaaactgcctgaattagtcaaggttctccagaggacaaaaaaaaaaatgcatatatacatatatggagatttattggagaactgactcacaagattatggagactgaaaagtccaccaatgattaattcattcattcatactttacatagtttaaaagtccctggcatcaagcagggtacccaggaaagccggtggtgcgattcagaccaaatctaaaggcctgagaactagggaggctgctggtgtaaatctcagagtccaaaggagttcaaaggcctaaaggaggcgctccatgtccaaaggcaggagaagatgtcccagctcaagaacagaacaaatttgcccttcctccactttcttgttctattcaggccctcgaagccagactgaatgacactcacccacatgggtgaggacaatcttctttactcagtcaactaagtcacatgttaatctcttccagaaacacactcaacagacagacctagaaataatgttttaccacttatctggtcattctttagtccagtcaagtttgacacataaaattagccatcacaccacctcaatcctctacacaaatttggctgaaactagcttgataagtctttctatcagaggcttcagtggaaaaactgaccaggtgatatggtttggctctgcatccccacccaaatctcatctcaaattgtaatccccatgtgtcgaggaaggacctgtaatccccatctgtcaacagaggaaggtgattggatcatgggggtggtttcccccatgctgttctcatgatagtgagtgagttctcatgagatctgatgcttttataaggggctcttccccctttgctttctctgtctctcctgccgccttgtgaagaaggtgcctgcttccccttccatcatgactgtaagtttcttgaggcctctccagccatgcagaactgtgagtcaattaaacgtcttccttttataaattacccagtctcagggaagttatttacagcagtgtgaaaatggattaatataccaggcaactccacagactctgggtatcttcttcaagtgtttcacaaatacagtttcccaatctttacagaacatgagactccaaaaataaccaaattctcacttcccctgctcacactccccccaaaaaatctactcaccacaaacaaagcaatctaatctgatagtagaaaaatcaaaattaatgaacagaaaaaaatctgttttggagataaaaaccagagaaccactggagaagatgacataaacagtgaaagatcacaggatggcttttcatcttcataactctgccattagtaaacaacacacactaatattttgcttctatgaaaatctcctgtataaattttcaaggaaaaattagtaatataaaaatatgaaaaatataaacttttttttttacttcgaaagtttttaatctcttagacaagtataattacagcaagcacttttctacaagtaactttaagctaatggacatataatggataacaataagcatcctagagtcaagttacctgggttcaagtgccagctctgccacttaggtgctgtgtgaccttgagaaaatcccttaacctttccctgctcagtttcctcctctataaaatgtggataatagcagctacctgagggagttgttataattaaatacattaacatataaagcatttaaaacagtgcctgacacatagcaaaatctaaataagtggtacttattattacaaatgaccaaaaattaagtgacagtaattggtacatctaatctcacctaaatgtcttttcatttaattgatgactgttctcctcactaaggacttctttaattcttccaacaggtgataaattgttactaggtttaagagccaaaggatacatattaaattttttgcaagactcaataaatatggttttatagcactaaacacttctaacaagagtaggaaaaaaaacatttcaggaaaaacgttttgtattaagaataggaaagtcaacagattgataccattaataccaatggacataatacttaaggcccaaaccacaccatattccactagcatttactaagtgtcaattgtgtgactggtgtttccaagatactggacatacaaagaagacaaggactctatccttaagggctcagggtgagtatacaggcaatacacaattatgttatgatgtaaactatggtttgaatgtgtcccccgaagttcatgtgttgggaacttaatccccaatgcaatagtgttgagaggtgagaaattcaagaggtgattagggtatgaaggctctgcccttctgaatggattaatgacattaaggtaggaatgggttactcataaaaagaataagttcagcccctcttaccccttttaacttccaccatgagataacacagcatgaaggccctcaccagatgccaccccttgaccttggacctctcagcctccagaactataaaaaaaaaaaaattcttttccttataaattacttaatctgtggcattctgctatagcaacatgaaatggactaagacaatgtattataacagaagtatgagcaaagtgcattacaggcaaaagaagaaatctgaacaaagccaaagaagcatgaaactgcatagcatatttggggaatggtaactcacctaatatggcttcagcattccatcaagaccttacattgctcttgttttttcaaacattaactacctgtcatgtgcaaggcaccaaagaaacagacatgtaatccatagcctctgggaaggtaatatctgtttcaggtgctaatgtataaatagaagttagctgcaagaacaaaggagtaagagcattctaggaaggagaaatggcatatgcaaaggcattctgagaaccaggaagagtttaacaagtctaaatccacgggaggatcccaagataaaggcagaggtgggatcattagatgttttggatgccaggcttttataacaaaagtgactagtaatcactaaaggatttaaaataagatcatgaccagatctgtgttttaacaaagcccttctgatagaaggccagtaaggagtaatccaggaggtaaaagggataaggaaatagcattagtgatggtgacagaaaaaaaggaaagaacatattcaagagggtcttcgatgagaaaatttggtaaaagtaaggaagaaggagattccttggatggtgccttgagttttttcctaatccctctatccccctagtagaaacatcttctcctttgaacctattttatttctacgttagtggacttttaggggggtacctatttattcatgtctccctcctcctactggtaaactcattatgggcagagactgtgccttatcccccttatattcttagcaggaccagaactagggtgaggagagtgaggcattcaacttcaggttcatgctggtacaaggttgaaatctgtttctatttaaaattttcatattttgttcatcacagactttttgcatacattttgattttttaaacattaaattaaaatattgtatattatttaatactttggcacactcttaaattttatacctgtggcaagtacctcacttacccctagtcaaagacctgatactcagtgtcttcctgacatagtacctaacacaagcaggtacttaaatgcatgttgaatgaaggaaaagcaaacaagtggcataagcaacaagatggatggtggtgggccttttacagagacagtgaatacaggaagagcaaaagactctagaggaacatgagtttataatgcatgtcagaagcactgcttggtgtattacagattaatttattattcaacactggaagcatgtataatggaaatattaaaggatgacattactcaaggaattgttctcaagatatttccccattctctttttaaaacttacactaatatttgaggtattgcagcaatatctaatttcttagttcagcttttaagttaacatttcttaggatgccaagatgagatgcttgttacatatatgtaccattaacactgctatggtatgaatgtttgtgttcccccaaaattcatatgttgaaatcctaatccccaagataatggtattaagaggtggaaccttttgggaagtaatcatgtcatgacagcaaagccctcacgaatggcattagcacctttattataaaggcccccgaaaaatgacttgcatcttccactatttgaggacacagctagaaagcaccatttaagaatcagagagagggccctaccagacacttcccaatctccagaagtctgagaaatgaattgtttataagccactcagtcaatggtatcttattatagctgcccaaatagactaaagacaaacacagtctttgatatgacttcatcaaacggcacccacatcactctatttctgtatccttgctcacttttcttcatagcatttatcactactagatgcagtataagttagttatttttcttccccctttaaaaaagattcactccatgagaacacagaatttttctgttttgttcatagttgtatccccagcacctagaataaatgccattgaaggtcatgacaaagagtgcgagggtggctgggggctggcttacactggagcagaaataagacaaaaaaaataaattaaaccctctgtggatacaaaactagagctaggcgctcacaagaatttaacagaaagccctaggagccaaaaacaaagatgcaattgcaaaccagagcaataagcttgggagcttacctgtagtcaccttgggaagtaaccagtgggcttgggtttaatagcctttggccagatgagattcaaatctctggataaagctgataccctcaaaggattacatacttggctatcactggcataccagaagataaaaggaaacttgcatttctcagcctgggctccgggaagaataaaaaagtctccctgagaattcttaaatatgacctagcctcctatctttggggctttaaatttataccacccagatggtcttggactcccaagccaagaaagtatatagtggttctgggtgtgatagttatcaatgtattttctcacagctcccaatgcacccttctttgtcttgctttatatattggagctggaccctacgagcattttcctttgacttctggctcaatgttaagcttcgtcaaaaggagggacaaggctgatcagcccattgaaaaaaaggtaagtgattccaaacaaactagttttacttattaaatataataaaacataaaatatttgtttctgaaaacctaacagaaagttaatacatagaattgtcatccaatatgaacatttccaatggtagggctggccttaagtcaagcttaatttttcatatactgaaacattacccatctaacatttgaacagattttttatctgattctcatctaactcaatagctgttatctttgaagatttatagcctcacacctaaatggatagcttttaagtagttttttaggccagtgggccccagattcatttatcataagattggttgcctatatatcccatttcacattccaaatatcttcccattttatagaatgataaagggttatatgcattttggatatagtaagaatgaaaatcattgagaaaaacctgggttgccaatttatatatttaatgcttatcagttaaactttaacttgctctatagtaactttaacttgcttatattaggactgcaaagtacaaaacatactccaacccagattctagcaagtaccaccttgcgaaggttaattttatctgtcaatttaaggtccccagatacttagtcaaacattatttggtgaaggtgtttaaatcggtagactgagtaaagcaggctgccctccctaacatggtaagcctcatccaattagttgaaagtctggatagaacaaaaaagttgaccttctcttgaataagaaaaaattcttccagcccaactgcctttaaaatgggatatcagttttttcctgccttctgacttgaactgaaacatcagctcttcctgggtctcaggcctgctggtcttcagaatggaaccacatcgctggctctcctggatctccagcttgcagatcttgcatcctgcaggtcttggaacttgtcagcctccataatcacacaagccaattccttataataaatgcctttatatacatatgcacatatcctattggctctgtttctctggagaaccctaatacacactgcaaatgacctcttattaactcctgctaaagcatcccgcctaaatagctacaaatgttccagacctttccctttctcctctcatttcaaaaggtaaaagtattgtgtttactatcttgtcttctcattgtccccattcccccatgctactaccttgtggaaacacattcctaccccacctctgtaattctgtggttagaacatgagctttgaaatcctgcctaccctctggattacagttgtttggctggatatcctccaagctgagccaatcagaagccataaatgtaaattagatttttgaaatttgtatttagaaactgaaagagagttgattgaagtccctctctgccaacaaccatgtgtgggagttaggcctaagaaaatgaaggagacacactgaaacagaggtaaaagctgaaagaaaaaaaaatagcatcctactgatacctaattccctcatttatacctgaagcttagcctcaccctgtctttccctgacccctttacagtagtcaataaattcccttttggcctaaactggtttgaattaggtttcagtcagtcacaactagagaagacacagtaaattcctactgcatgtaaatcattacagaaatctgtgaattatattaaaaataaccaaacttagttattcaaatgttttctaaaatctgtttgccataaattgatattattcaaaaatatatatatgttccatatttgtcctagaaacattaacattgaagctacttaaaatgcaaagattgcctaggaagaatgtctctttgcttgtttttacaagggacttatcaaattagaaagcaaaattagaaatcataatgagttccatgttctctggtgaacactatgaggtaccattaaaaatgttatataaaccaggagcagcggctcacacctgtaataccagcactttgggaagctaaggcaggaggatcacttgggcccaggagtttgagactgcagtgacttatgatggcaccactgcactctagcctgggcaacacagtgataccccatctctttaaaagaaaaaaaagaagaagaaacaagaatatgctgctttaagtttgtactatttttataaattaattttaattttaaaaaacactttaactgctatataaaaataatactataactaaaaatattgtaatctgaatctttaaggaaaaccatacaaatttactaaatgaggttatcattaccaaatatcttcttggcacttttaagttttaaattgagtgttttcttagctggttgaaggctgaaattcattatcttcttatagaactcttgttatatagaaaacacttaattatgaagtagttattcatacacatgaaagataaactggtcctgaatttcctcctcaataatataaatgttatcctaagaaacaggaaaaaaatggtggcttgggtaattaaaattcagagataaacacaatcttcagtacccaaattcaattgaattcaaagtcttcaaccacctattattttattttattttattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctcacctattattttataaagctgctgacaaatattaaagttttaatagttgttttctctaatttgattgcccttatagattttcctgaatgatgtgctaagtagcataattgtgaataagcagaaagtaagagagaatataaaaagctaacacacatatacacttcaaaaacaaacttgatgagaacttagtcacaaagggtataaaccctctcaggatcgtaactccaggtgacttttctttttcactcttactaattttaccaactacgaaagggaatcagataatcctagaataggtaagagaggaaaagcaggcttggaagtgatcaacagactctatataaggccactaaaggaactagggagtgataagtaaactagttagtagaagtattaataaaaatttcaggccccagaatcatgctcacagattggaaaggttagatttttctgttgctttaatattatacaattgcaggaaatattataagcttcatttgtccaacagcatcatgagaacaggtaatgaatacaatatttcaggttcagctcacagaactaattttcataaattcttatataagtgaaaaacctcttatcctattgcaatgttctcaatctcattgccattaagactcttcacacaataaccactcagttaagagaatgacagagggattttttttcatgtgttttttggctgcataaatgtcttcttttgagaagtgtctgttcatatccttcgcccacttgttgatggggtggtttgttttgttcttgtaaatttgtttgagttcattgtagattctggatattagccctttgtcagatgagtaggttgcaaaaattttctcccattctgtaggttgcctgttcactctgatggtagtttcttttgctgtgcagaagctttttagtttaattaggtcccatttgtcaattttggcttttgttgccattgcttttggtgttttagacatgaagtccttgcccatgcctatgttctgaatggtattgcctaggttttcttctagggtttttatggttttaggtctaacatttaagtctttaatccatcttgaattaatttttgtataaggtgtaaggaagggatccagtttcagccttctacatgtggctagccagttttcccaacaccatttattaaaaagggaatcctttccccattgcttgtttttctcaggtttgtcaaagatcagatagttgcagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccacatgaactttaaagtagttttttccaattctgtgaagaaagtcattggtagcttgatggggatggcattgaatctataaattacctggggccgtatggccattttcacaatattgattcttcctacccatgagcatggaatgttcttccatttgtttgtatcctcttttatttcgttgagcagtggtttgtagttctccttgaagaagtccttcacatcccttgtaagttggattcctaggtattttattctctttgaagcaattgtgaatgggagttcactcatgatttggctctctgtttgtctgttattggtgtataagaatgcttgtgatttttgtacattgattttgtatactgagactttgctgaagttgcttatcagcttgaggagattttgggctgagacaatggggttttctagatatacaatcatgtcatctgcaaacagggacaatttgacttcttcttttcctaatcgaatatcctctatttccttctcctgcctgattgccctggccagaacttccaacactatgttgaacaggagtggtgagagagggcatccctgtcttgtgcccgttttcaaagggaatgcttcatcatcactggccatcagagaaatgcaaatcaaaaccacaatgagataccatctcacaccagttagaatggcgatcattaaaaagtcaggaaacaacaggtgccggaaaggatgtggagaaataggaatacttttacactgttggtgggactgtaaactagttcaaccattgtggaagtcagtgtggtgattcctcagggatctagaactagaagtaccatttgacccagccatcccattactgggtatatacccaaaggattacaaatcatgctgctataaagacacatgcgaaggtatgtttatagcggcactattcacaatagcaaagacttggaaccaacccaaatgtccaacaatgatagactggattaagaaaatgtggcacacatacaccatggaatactatgcagccataaaaatgatgagttcatgtcctttgtagggacatggatgaaactggaaaccatcattctcagcaaactatcacaaggacaaaaaaccgaacactgcatgttctcactcataggtggaattgaacaatgagaacacacggacacaggaaggggaacatcacacaccagggactgttgtggggtcgggggagaggggagggatagcattaggagatatacctaatgctaaatgatgagttaatggttgcagcacaccaacgtggcacatgtatacatatgtaacaaacctgcacgttgtgcacatgtaccctaaaacttaaagtataataataataaaatttaaaaaaaaagagaatgacagagggattaccaaaacagaaagggtacacatgctgatagtaatatccaattcacaaatattcctctacgcagttctaacccaggaaatatgtcttgtaattatgaaactttgatattttctgctatatagaagcattcattctaaacagtgaaatattctaaaaagttttgagtctatattaaggagaacattttaattaatgtgtctatcaaaataaaattagagttaatataagcaacatcaatgaaaggtttgtggaaaagaatgttttatttttatgggtacatagtgtatgtatttatggggtacatgagaaattttgatacagaaatacagtgtgtaataatcacatcagggtaaacagggtatccatcacctcaagcatttatttctttgtgttacaaacattccaattatactctagttattttaaaatatataataaattaatgttgactgtagtcaccctgttgtgctatcaaatgctaggtcttattcattccctctaattatatttttgtacccattaaccatccccactgccctactccccttcccagcctctggtaaccatcatcctactctcttatattcatgagttcaattgttttcatttttagcttcagcaaatgagtgagaacatgcaaagtttctctttctgtgcctggcttatttcacttgacataacgtcttccaattccatccatgttgttgcaaattacaggatctcattatttacaattgaataatactacattgtgtatacgtgacacattttcttcatctatttgtctgttgatggacacttaggttgattccaaattttggctattgggaatagtgctgcaataaacatgggggtgtaaatatgtctttgatatattgatttcttttcttttgggcatatacttagcaatgggattgctggatcatatggtatttctctatatttctagttgtttgaggaacctccatactgttctccatagtggctctactaatttacattcccaccaacagcatacaaatgttcccttttctccacatcttctacagcattcattattgcctgtcttttggaggtaagccattgtaactggggtgaaatgatatctccttgtagttttgatttgcatttctctgatgatcagtgatgttgaacatcttttcatatgcctgtctgccatttgtatgtcttcttttgataaatgtcttttcaaatattttgccaatattttaattgaattactagatttttttcccatagagttgtttgagctccttatatattctggttattaatcccttgtcagatggatagtttgcaaatattttctctcattctgtggattgtctcttcattgtttcctttactgtgcagaagctttttaacttgatgtgatcccatttgtccatgtttgctttggttgcctgtgcttgtgaggtattactcaagaaatctttgcccagtccaatgtcctgaagagtttctacaaaattttcttgtaccaatttcatagtctggggtcttaaagtctttaatccattctgatttgatttttttagatggcaagagataggggtccagtttcattcttgtgcatatggatatcaagttttcccagcaccatttactgaagagactgtctttttccccaatgtacgttctggcacctttgtcaaaaatgagttcactgtaggtgtgtggatttgtttctgggttctctattctgttccattggtctgtgtctgtttttatgccagtactgtgctgtgttggtcactatagctctgtagtataatttgaattcagataatgtgattcctccggttttgttcattttgcttgggatggctttgtctattttgggtcctttgtggttccatataaattttaggattattttttatgtttctgtgaagaatatcactggtattttgatagggattacattgaatctgtagactgctttgggtagtatggacattttgacaatagtgattcttccaatccatgaacatgaaatatttttccatttttccatgtcctcttcaatttcttgcatcagtgttgtatagttttcactgtagaaatctttcacatctttggttaagtttattcctgggtatttttttatgagattactttcttgatttctttttaagactgttcaccctggcatatagaacactactgattttttatgttggttttgtattctgcaactttactgaatgtgtttatcagttctaatagttttttggtgggggcttcaggtttttctaaatataagactatatcatctgcaaacaaggataatttgacttcttcctttccattttggatgctctttctttctttctcttgtctgattgcttagctgggacttgcagtaccatgttgaataacagtagtgaaaggaagcatctttgtcttgttctagattttatgggaaaggttttccatttttccccattcagtaagatactagctgtgggtctgttgtatattgcttttactgtgttcaagtatgttccttctattccaagtgttttgagggttttatcatgaagggatgttgaattttatcaaatgttttttcagtatcaaatgaaatgatcatatagtttttctcagtatctaatgaaatgatcatatagtttttgtccttcattctgttgatatgatgtatcacagtgattgatctgtgcatgttgaaccatccttacctccctgggataaatcccacttggtcatgataaatgatctttttgatgtgttgttagatttggcttgctagtgttttgttgaggatttctgcatcaatgttcatcagtaatactggcctgtagttttctttttttgatgtatctttgtctggttttggtatcaaggtaatactgaccttgcagaatgaacctggaaggagaaactacttccatttttcagaatagtttgagtagagctggtattaatttttctttaaatgtttggtaaaatttagcagtgaagtcattggatcctcggcttctctttgctgggagactttttattacagctcagtcttgtcagttgttattggtctgttcaagttttggatttcttcatggttaaatcttggtagggtatgtgattaggaatttatccatttcttctaactattccaatttttttggtatatagctgctcacactagtctctaatgatcttttgaatttctgcagtatacatcataatgtctgttttttcatctctgattttactggatcttctctttttcttagtctggctaaaggtttcccaattttgtttatctttcgaaaaccaacttggtgaaaaagattaaattcagtaggtcttaaatactttggtactttaggagattaatacaaaaaagaaaaaaagacatggattcttcaaacatctcacaatgaagagaggataaacacattaattttgtatataaaggagggaggagatatgtacataaatgcttgtctaagtatagaatctctacagaaggatatgtgaaaaccaaaaagaatgattgcctttgggtcagaggactgggggactggtgatctgggataagagcacttaattttcattatatactatttcccactgttggaatatttgaatgtatatacagtcctttctattccgataaataaattaaaaagcataaaccatatataaaataacttttacaaaacaaagttaaacgtaagagatataaattacacttgatattcaaaggatagaaagatcctattcacctacagaagcagagtaagtaccaataagggggtggtccatgagatggatgggtagaatagatatataacaaaaatcattccagggaagagaacacctgactatagccacaaagttgggaagggatggggcgtgtttagaaaagtgatagtttagaagcttaggctgcatataaggatgtgttctttttctgtagatgcctgacaaaaaaaaaaaaaaactatacagttagcatcttaaagaacgcacatttaccatctcacaggttttgtggtcaggagtctgaattagctaggtcctctacacagggtctcacaggctgaaatcaaaatgtccaccaagactatggtttcctcttaagcatagggccctcttttaacatcactggttgctgacataattcatttccctgcagttttaagacagacactcacccattttcttgctgtcagtcaggagccactctcaacttctagatgccaccagcgattccctgcctagtagtccctcaataagccctctaatgctcccaagatttgaatctttctaacttcagagaaaacccaatcccttttaaaggctcacttgattagatcaggcccacccagataatggccctcttaactgacttaaagtcaactgattagtgacctcatcacaagtgactctacaggatgtgtaccctataggatgacgtattagtccattctcacattgctataaggaaatacctgacactggataatttataaagaaaagaagtttaattgactcacagttccgcatggctgaggcctcaggaaacttacaatcatggcagaaggcacctcctcacagggcagcaggagaaagaatgagtgcaagcaggggaaatgccagatgtttataaaatgatcagattttgcgagactcactatcacaagaacagcatgggggaaaccaaccccatgatctgattacctccacctggtcctgccctggatgtatggggattatgaggattacaatccaaggtgagatttgggtggggacatggagccaaaccatatcaggtgagaatcttgggagccatcctagaattctgccaagcatagctggtaacagaagatgagaacaaaaattctcaaaagctaagccaaaattaaatagttttccatcctatatttctgtctccaaacgttatgctacttgtaaaatacacagggataattaggccaggcacagtggctcacacctgtaatcccagcactttgggaggtcaagatgggaggatcacttgaggccaggagttcaggaccagcctggccaatatggcaagaccccatctcttaaaaaaatggataattacagttgcaactgagaaacctcccatatttggtaactgtctactctttggctatttgtggtactcatttattataaggcctatgttactgactgggaatatctacttctcccttcgcagtcttttattcaatataaaccattcctacctctgtttgctgtactcttggctgccttgtctgttactgttagattaatatttaacttactaaggtcctcctcactccacaaagacctagcctctttattacttttttcccgctattttcagccattacttttgtgaccttgcataaattcacactagaaaagtgtaagtattcaatggttatatagcttccaactttgtttttgcagttttataaccttatttgatgtattcaatgatcagtagtttgttctcatctacactgaatgactatagattttttaaagtggaaacaggtacataggtaaccaaagtatacagcttgcttgggaaccttcatcctcattatgtttctggacaaccacatatggatacagtatgggacatcccttaaccttaggcctagtcagctttgttgaacctgttatcaatacgcacatctggagttcccatctccttcatgatggcaaatttctggatctctctgagtgccccaggggcatgcttcttgaagcccactcatggatgtgcttctgagtgttgatggtgtattcttgtgtcaccacctcattgacagcaggagagcccttcttcttcccacccttctctgcaggggccattctgccaggccaaagttggaaagtaacctccatcttaactacccaagaaagaagaaaaacaaacagcatagctttggtgtaagcaaaatgtcaattctacagctacatggtcaataagtatacacataattaatatttctacaatgttgaatatgattatttaggaaaacaagtctcagagttagaaatacccacttctcctttgatctggcagcttatattcttctcacagacaaaaatcaaaagcccttgataattttgcctgctgattgggaggcaatgctgatagacaaagaagtagaacactatgaaaagaaggcctcctgatacagttgctagtctttcctgacaacgtggcatatggttccaaatcttcaaacagctatcatattgctacactgatttaacaaggtgatctgtattctcccaaattaaatacatgtagagcactaggataccttcttctgagaaaaggggtatttattttctttctttgatactagatttatagcataacagttaagcctgcaagtaccaactgagtttctactaagtgtaacacattgtctagtaggtgggtgatggtagcaaagagaagatacatgataaatcagtcatgaatcctgccctcaagttatatataataagtgaaaagaaaatcctgggagcagaatcgacccaattttcctttctcttctgatgtcaggtgggctctgaacacaatcctcataatccccatttcctagtttccatgcaccattgtgatccctccccttgagtatgggcaggacctgtggcttgtttctagtcaaaagaataagcaaaggtgacacgacagatgggatacatgtacatgactatgtgattatgttacacaaacttgtcatacccattttgttggagtctctgtcttttaccggctttaaggaagcaagtggccatatggccaggaactgcaggacgattctagttgctgaagctggctctggactgatagccagcaagaaattgaaaccctcagtcctacaaccacaggaattaaattctgccaacagctgaaatgagcttgaaaacatctccttccctaattgagccccagttgagaactaagtactggcaaatatgttgattgaagctttgtgagaccttgagcagaggattcaagtcagctgtgccctgactcctggccccaaaaactatgagacaacaagtacacattgctttaagccactaagtttatgataatattgttatacaacaatagatgactaacacatctttcttcttatattattcaagttgctaacatatcataagaggtaaactcaagtattctgaacatccagtcaccactggtgacatgaaatccccagcccacatgctagagaaaaccagagttggtcacacagccagacccttttgtaagattcaagcggcaatttgccaccaatattgccaaaatagccagtatggctgcccaattaacagatcaaaaactaaagatcagctgctaattcctgccttgtacattctcagagagtaaggaccttccatttcccgactaaatgctcagaatgagccatcaggcctgttaggtaaaaatgagaaatttgaaggatcaagcggccccgcagacgctggtagagagggcaagcttaaggtgtagaagaaaactgtcattcccacttaatccaaaaaagtaaaaatatatgcctcctattttctttcagatataataaccaccttttcttaaacaatagcttatttgggggcctgcattcattacaaacaaaccagagtaggcttatatatcatctgaaggttcttttttaaaaaatttcttttgagacagggtcttgctctgtcacctagactggagtgcagtggcacaatcataactcactgcagcctcgacctactgggctcaaggaattcttctgcctcagcccctgagtatctaggactacaggtgactgtgaccacagccaggtacttttctattttttgtagagatgggatctcactgtgtttcccaggctggtctcaaactcctgggctcaagcaatcctcccacctcagcctcccaaagtgctgggattacaggtgtgagccaccatgcccagctaatttttattttttcttttttgtagagacaggggtctcactatgttgaccagaatagtcttgaactcctggaggatagtaatcctcctgccccagccttcgaaagtgctgggattacaagtgtgagccactgtgcccggccacatgaaggttctttccattgttcttccagaagtctcatcatcacaggctcattgtagtataaatattttcacataaggaatgaaagtgatgtgttagcatgatcttatcaggatcaaggtaactaaaaacaaatgacaaggtttctctttttattattcaacattgagaagcagaaaagtgttcaactgttactgtatttatttaatgctcaccttttaaagagtaaattcagttagttacgtgttataaaatgtgagataagacataatcctagagtaatgaaattttctcctttgtaaaaggagattcactataatttttcatgtaaagggaacatgaaaccaataacctagttccaaatggacagctaataaaattaagtttgcacatttaagagaaagttattttaatttcctttaattgtatacaatgttaaaaaggctttttgcaaatcattaacagttaagacgtactttcattgacaatttaggtagacaaaatattcaatgttgtgtgacaaaatcattcttataacattagtaaatgcataagcacatttccaaaaattgcaagaaataaaagccaaataattggaaagaatacacatttactctaagtaaagcttgattatacgcccagagatgagcatgcaaagtatagcctaatctatactcccacaatgcctcaaggtatctctgagtgccctgtttgtgaacatctgggtcagttctatggctgacaccacaatgtcctaaatagggcatgacaataaatgaaatgtacaataatgtaaagcagtataacctctagatacaataaggcactaaatgtaacaacgttaaaaatcagcaatatagaagctaataataaaacaaaacaaaaacatttatgggggtttcagggggaaaaaaactaggcagagtaaatgaaagataatctgtaggttacctctattcgctcctatcaggggcaagattcacatcctggtctctcccctgctaatacctgatgaatcaaactgatgaacatacagccaatcaacgaagccaaaaaaaatgatacttaaaataaatacctgaaaagatggatcccacattacatcttacttaacgcttccaacttgctatgagaaagatactaagatacgcaaagttgaaagtgattcaaattccacactaacaatttaaatgccttgtaagagaaagaatattcacacataataatacaaagcaaagcatgagatgagtcatgagaagatacaagtaaagtgggaccagagcttagagggtgaaagacgacttctagctaagataaggaagggcatcacagaggaaggggcatttaagttagattttaaaagatagaatttgaaaatacagactatagtagccttcatttcaatcaaaagcagcagcatatgccttcataactgcaatgaaatattatgtacgtaattattgaatgtctctcttcctcaatagatgtcaagttctgagagggctgagactatactttttcaatggtctccttagtacctagcagaatatctggtatgtcacagatgttcaacaaatatttattaaaggaataaataaacagaggcaggaatatagaggacaaatcgctcaatttgcctagtaaatatagaagacagggacatgaagaacaaaagatcacttaaggtgaaatgacagaagaccttgaaaagtcaaactgaagaatgtttatttggttggaaataaggagtcactgaagatctttatggaatgtagtgacataactagatctgtgctttcaaaagtatatctaaaagtaatgtacatggcagactacaaaaaagataaaatgaagaagtcaagagatcattataggagtctagatcaaagataacaaggacctgaagtagaataaaggcagtgggaatagaaagttaaaaaaaaaaataacgacagggatattaaacagataaaatcaatagaacaatcagttagttatccattccacaaacatcttttgagcaactactacatatctaccagacactgccaggagctggagacaggaaaaataaaataagctgtagtccttcacctcagagttgagagtcaatctgtcatctcaataagaaaaactgattgaaaactgatctcctagctaagataaggaaaggcatcatagaggaaggagcatttaagttgaattttaaaagacagtttgaaaatgtagaatatggtagactttatttcagccctttcagaataacacaataaatgaagaaagggagaagtcaatgcctctcttaaattttgagaacagaaactaagaggatggcatcaccatgcagagaatggaagaacaaaacagaagaaggtggacagggaggacggtatggacagattctgacacactgtctttgtgtggaatacgcaagtgaaaatgttcctgaattagttgcaaattcagaactggaggacagagcacagattagggcttatgatttgaaaggcatctagcataaatatgagagctgaaattgagagcagacaaggtaagaaagggtgaaacatgtagaaccttggagatgatccatatttaacgagatgagagaaggcaaagggaagaattaagagaaaattatcagaaaatcaaaccaagccaaaccaggaaagaggagagcaatcagaggcaaaaggatcatcaggacaacaataagtgtttccagaagcatggaccatcaacagcattatttgcaacagagaaatcacggaaaattaggactgacaaaaaggccactggatttgggaataaaagaaatgtattagtgatatttgagagagcagcagagtgataagggaaaactcagtttgcaaggagttaaggtatcagtgaatggtgaggcagtggagatagctggaacaaactgctctcttgaagtctgaaaatgaaggaaaagaaaatgatggaacaatagcttgagggacaacagaaggaagaaaaaaatttaggctaaggaaagattatatgagtatgtcttttgttggagaaaaagtggacaaaaaaagcaacattttttttagaacaggaaagagcagagatagaagatccagtaaaggcataaatcaaagatgcataaaatacttgatgtattcattcaataagtatttattgaatgcccaccataaactcaaaactggagaatatacaccggagaacaagctaggtaggatcccaagctcatggagcttgtatgtctaagcttccagaggaaaaggaagaatacagtggacagggtagaatgcctttattctaccctgttgttgcagaacagccacagagtttggatggaattaattccactgctaccaatggtctcagaaatcagcatcatcttatctgtgttatcagggtatttgattcacgaatgaccacacaacctaagttggtcctatcagaatgaaacctgggactttgattaaatggaaaagaggacaatcctgatcgacaaaatgtgctgaggtgaggtcgggaactgttgcatacattttgctacctgaaagaagcccacttgtgctgaaggcaacatagaggaggattgagctgagagaattatggctgtaaaaaatgaaactctgatcaaaccacatctgaaacccatcctttctttggacttttcagttacatgatccaaaacatctctttctttgtttaaggccatttaagccgagctttttgataatttcaagtaaaaccatcctaattacaaattagatgtcactgtaggcacaagtaaaacggttataaaactgcagcacaaaataagacctgcccagtgcagataccagagactgtgccctttctccactcttctggctttagctgtctgtattagtcagttctcacgctgctaataaagatatacacaacactgggtaatttataaaggaaagaggtttaactgactctcagttccacatggctggggaggactcacaatcatggcagaaggcaaaggaggagcaaagtcatgtcctgcatggcagcaggcaagagaaaacttgtgtaagagaactcccctttataaaaccagatctcgtgagacttactcactatcatgagaacagtatgggaaagacccacccccatgattcaattaccccccaccaggtccctgccacaacatgcggggattatggaagctacagttcaagatttgggtggggacacagctgaaacatatcactgttcatggttctaagctttgaaactacaactcattctcttttttttaaattatactttaagttctgggatacatgtgcagaacatgcaggttacataggtatacatatgccatggtggtttgctgcacccatcaacccatcatctacattaggtatttctcctaatgctatccctcccctagcccccaccccgcgacaggccccagtgtgtgatgttcccctccctgtgcccatatgttctcattgttcaactcctgctccttctcctataaatcctttccccactcctccacccaaggttattttctcttcatcagcccctaaacttcaagagatcttagcagcctgggagcataagggcactcttcctctcagcagcatccaaatttaccccatcttcatgctccagaattaagtgagaggggcctatgacttgagcaacagtcaccaataagggaattcttgggcctaggcccagcgaatatcctttctgcaagtttgcccctgtggctgtatcaaccctgagtttccatcttttcgtatcaatctggctgacttctcttcctttgaaactagactcacagtgcatctcctcctggaaggcctccttcccagtggcccttggccgtcagatgctgctcctcagggttcccatgaaaatcaatactcacctcctcctagccacacagacatggaaggacagagctagatacaatgtgatgttgttcttactgggacaaggattacactttattttatttgtgtataacctacatgtgtgggggaaatgaatgtcacttgtaatgtggaggaatgggtgctggactcgcaggcaaaacacaagacttccaggcatgaggggatttcttacaagttgcaggacctctccaagattcttaatctataaggactttatcactgggttgttgtgagattaagaagcatactgaatctgaaaagtattgtagtcctttgagaatgatacctagaaatatttttgttggatattatgaatgttcagaggaggcaagagatgccttcttgctagggattgctagggaaaaactggagacatagataagtgaaaaactcaagaagaagctggcctttaagctgactttggagaatgtgtaagatttagacatgctgaaatggggatggggagaggtagccaggtgaaggaagccaaaagctgagaagccagcatcaacttagcagctaattttactaagcaaatatgtgccaaccactcttctaagtgccagggttacaacagtgaaaaattcagaggaggcccctaccctaagagggtttacattccagttgggaaagacagacaataaacaaagacaaagatatgaaatgatttctgttagaggtaagtgatgtgaaggtgatgtgctatggggactggaggggaaacattccaggtaaggtagtaaaggccattctgaggtgatgacatttaacctgggaagaaagtgataaaatagagtggagctgaggaagaatatgccaaaggaaataccaggtgcaaaggccctgaagtaggaacaagcttggcgtgtttgtaaaaccagaaaaaaaaaaaaaaagccaatgtggctacagcaaagtggacaaaaacaaaagtagtatgagattaaggctgaggttatatctaagtaacagcacggtgtcagtttagattgaagtttgtagtagtagatgatccttgaaaacaaatttgggctagaattagaaaatctcagacaccaaattaaggtggatatatttcattcttcaaaagcaattgtctcacaatataatgagccaggtctgcgaggcaagtcctcagggatgcccacagatatttctcataaattaggtgactcttgtggaggtcatgggcacttaatccagaacaccaaggcagcaaggcaaagcagctgcgagactgttggtgacgtggaacacagactgagcagaaagttctctagctcaatttcccctgttgcaggaagaaatgaagcccagagaagaaaacaggcctgggaggagagagagtagacatcataactgatgttcaccaatacgtggttctcctctagttctgcccaaacaagaatgataatgtgtcactttgggaccaaagcatttaattgctggtgtttggctccccgaacctgccatggcaatcacttgttaccatggaggtgttatagacaggtacagtgtagaatgcagagccaatatctggagggaggctgccatggagaatcccccagatccactctggtggtgttaactcactgagaaattggaggttgtttgttatggaaggataacctaacctgtaatgattaatacaggatatagacagagtttttaaaaagaccagaaagagtagacattcttgctctgagtggggaaaggaggaggagagaatatgagatactactcaatgtctctgacagcatgcattttttgccccaattctccattcttggctagatcagtgacctttatcagatatgtaagccttgcacaaaataccatagactgggtggattattaaacagaaatttattttctcacatttctggaggctgcaaatctgagatcagggtgccagcatggtagagttctggtgtgcagatggccaccttctcgctgtgtcctcacatgacaaagagagaaagagagcaagctctctggtgtctcttcctataaaagctctaagcccatcatgagggccctaccctcatgacctcatctaaacctaattatatctcaaaggccccatccccaaataccatcacattgggggtcagggcttcaatatatgaaattttgggcaatggatatgattccatctatatctgagtgttttctcccactctttggtttacactttggccatgtgatttgcttggctaacagaatgagctggaattgacagtatatgccagttccaaagccaagccttaaagagcccttacatgttaacagtttcccccttgcacctctgctatgggcatgagaagaacatggcatggctagaccattccacaaaggaggacagaaatacatggagtactaccaccactgcaaacacatattgcaacaatctgcaacatgcagaaccacgacccaccaagcctgcagcataaatgacaaatgattatgtttttaagacagcaagtttgtggtggtttgttaggaagcactactggggcagtaggtaattgatctatataatgactacaggaaaatggccaaggaggacctgtggctctttaggaagagtcttatgctaacaaagctgcctaggaaaattaagttgtactgctccaaagactcttctcttcaaatcctgttttcttatttaccttttccagttccctgaaataggtcctaaattcaactctgatactggtcagcaaggtttgtgaagaagacaaaagcactggggagggggatacagaatcataaagtaatacaaaaaaaaaaaaaacagaaaagaaaatttcaggggagaaaaatcaagtgcaatacaaaacaccaaaggaaatgagatctgaggtctctaagtttactaagaaggctagtcatcatgaagccatttttggacaccagggagacagaggcatgggagttcaggaaaaaacaagtggcaagaaaattgagacagtgagtttaaatcattgagtttagaaacgtaacaatgaaaagaataaaaaatagagcaacaactagtggagcaggaaatagaattcatttcctaatacagaagacctatatatataggtttctatatcagtgctatatcagtgctatatcagttttctgttgccacaaaacaaattattacaaacttattatctcacggttttgtaggtcagaagtctgagtgagcttagctggggtctctgcttcaagtctcacaaagccagcatcaaggtgtcaaccaaactgggctcttatctggaagttctagagaataagacctccgggcatattcaggtggttggcagaattcagttccacacagcaaataggactgaagtccccatttccttgctggctattggctggaggttgctcacaactcctagatgctgttctctggccctgcatgtgctcatctccatcttcaaagtcagcaatggtgcactggacctttatcatattttgaatgtccctgacttcttcttctaatagcagctagaaacaaatctgttcaaaggcccatgtgactgtattagacccagataacctccctaccttaaggtcaactgattaggaacctcaattatatctcaaaaccccttgtgctgtgtaacctaacataattatggaagtaacagccatcatatttacagtcctagaaattatggcagaaatcttagagggccatcttaggattctgcctaccacatgtacacatttaaagttgaaaaagatccaaaagcgaaaagaccttgaagaagattttaaatagaaccttgtattacacaaattacctataaataggaaggaaagaaatcaaggaaaaagtatgccatcctggccatagcaaaaaaaaagaaggatgccttttattggagatttgaagaaagaattaaaaaaaaaaagaaaaaaaaaggcagaggcaaaagacaccttttatgccaactatttactttgccaaaattagtatcattttaatttagatacaaagaaacatattctaggctctttgaaaaagttcctccagatggttacatctccctggagtgacagcacctagcgtagccttgcacatattgggaattcaattaaacactgctgaccatctgattgagaattcagaggctggagtagctgactcaatataaacatatggcttagttcccatcaaaggaaaaatcaagtcactctattctcctccccaacatcgcacctcctttgcaatgtaggagaaaacagatatgaactaataaaaatagacgatgtaacagagattaggaaacaggcaaactggagaatacaaaatttctctaattttaccataaaatcagaatgcttcagctaaggatcagcactgtaaatatgtcattcttaattcaattgcattcaatcagatcaatactttccgatcatggcttcaggatatttaagatggggaagacacaatctgagcccagctgctaagtgttgggggataggagaagcacacaaatgactatactgtgaggttgagctatattaattgtggaaagccaaatgaagataagaaaacaaattaaaccacttttaaccctcttaagagccatatgaaatatttatacatgagaaaaagcctcaggcagatcaaaaatatttttcaagatcatataccaagtatattgtagggtacagattcaaattcaagactgactccaaactcagtctctcccaaagaagaggcaaatcacctctggttggctagttggatgggagtttggaggctggtggagagaaaccaggaacagtttcttagggaagcagttatttcaggtaaaacttggaaagatatacacagttttgaaaagctgagatggcaaagaaggagaacatttccaggaggaacagcaaaaagcacagaagcaagaaatcaggatcaacatttggagaatggtgagtagatcaagtagcacaaactctttacaaataaagatagattggatgcacattctggaagtcaaatattggggttaataagttactgtaatagttcagggaagagcctaaactagaatctcagacatgaaaaaggagaaaaggagaagaggggactaatgtgaggagtcagatggaagattactctcttatgtttacattacagtcaacaacaacaacaaaaaagacagccaagtccaaaaactaagcttggattcaaaagaaaaaagtcatccctctgccaccctcttttgccctctagtctagaggttagtaaactatggcccacagggcaaattcaacccaccatctgtctctgtaaataaaattctactggaacacagccgtgtccactcatttacggattgttaatggctgctttcaccctataatagcaaagactatgtggtccacaagacctaaaatatttactttctagtgctttacagaaaaaaaaaaattgtcaacgcttgctctagttccatactccacaagccactcttatttgtttgtttgtttgtttgtgacagggtctcactctgtaacccagactggagtgcagtagcacgatcacagctcactgcaggctaaagcaattctctcacctcagcctcccaaatagctgggattacaggtgcacgccatcatgctcagttaatttttttttttttttttttttttttttagcagagacgagctctgtctgtgttgcccaggcttgtctcaaactcctgggctcaaacaatcacctgcctaggcctcccaaagtgctgagattacaggcgtaagccacttcacctggcctgttccaattcttttagtagcttgttctcatctaaatattaagcttatttggatatttcctgactgataaattatcaagactatcatttgaattcctattatagtaactgagactttggcttgcttgcaccatcagccttccccgcatcctccccactctccttccccaccacacatactttcctttccccgtatgaatatatatttatattcgtagtgtttgcaacattattgtgactacataaatattcttcattactgagccagataatgtaatgtaattatgtttatgtttccatgcttataaaaatgttattttctgaagttaatagttatcatttgtttcatttgcttagtttttcatttacctatcactattttttctgagtccaacacatttgttctgttcatttttttccaaacattcaaacacaccaaatacttcatttttatttgttcccctcaaaaccaccccccccaataaccctccatcctttttctctaatctgagtggttgctctcaaggcctagtgaacagttgcttttctggaacttctctctgccctgccatattgagtctgttctcctgaatcctatgtctttctctttattgattttctcccttgttttatggaagctcatcctccagaagctttctatgaaatcacacataagatataaattgtttaatccttccaggacttagaatttcttcattctgtcctcatatctaattgatactttcagccggatagagaaatctaaactgaaaaggatttccccctcagaattttgaaagcattgcaccactgtcctctaccagccagtgttgccataagagtttgatgccattctgatttccatccatctctatgtgacttgtgttaatgctttgtttcattttatactcccttcacaaagcttttaggaccttattttaatctatgatgttcttacatttcagaatgacatggctggtattcttttctcatttattgtgctagatacttgggcagccttttcagtctagagacttacatccaccggtactaggaaattttcttgtaatatttctttgatagcttccttcctttttcttgtcctctatttgtatcaggcaacctgtagctataataaggcttcataataaaccatcctaaaactcagagacataaaacaatagccattcataattgttctagaatctaccagtcagtcaggcagttctgctgatcttggttggatttggctagggagttctttttggtgttgactagacctcacacaggtatctggggtaggctggctgttagctgaatttaaatggtatttggagctagtgcagtggctcatacctataatctcagcactctgggaggctgaagcaggcagatcacctgaagccaggagctcgagatcagccttggcaacatagcaagaccttgcctctaccgaaaaaaaaaaaaaaattaaaattagccaggcacaatggcccatgcctgtagtcccaactataactcaggaggctgagccggaagatcacttgagcccagcagttggaggttacagtaagctgtgatcctgccactgcactctagccaaggagacagcgagactctttaattaattaatggtattaggtaggacagggacctgtttcatgagtctcatccacaagcatgttttcatgataatcacagaggtttcagacattgtatacacgtatcaaaatatcacactttagccaataatggatgcactttaaaaaaagaagaaaaaagtatcacccataaatatgtacaattatatgtcagttaaaataacagtagaagaaaaaatgtgctttttaagcctctgttgtgtcaagttttctataacaaaattgatcaaattgggtcacataaccaagtccagagtcagtatggagggcacctgcaaaaggcttggatacatgaattcatgcatggaacccctattggtcagatcttggaaatgctgaattgatcctctaattttcttttctttcctatgttccatctcttaggtttattttttttctttgttgctgctgctgttgttgatgatccactttctatgagatttcttcaatgttatcctgaaacttctaaaattttttatgttagttcataataaattttaaatttccaaactactttcttgttatctaattttacctgtttcatagcatccgttcttgttttaaaagtacaatatcttctcttattactctaatgaaattagtaagagtttttggaagtattcttcttgaattgcctctgcttccctcagcaggtgaagggaagtttcacccaacttcccacagcagagaaaggtatctgggtgatctaaaggctcttgtactttcaaccaagatccatgttctgctctgtgttttactcccagtttttgtggtgccgggagtttccaaatgtgagtctctaaagggtttgcatctcatcaatgtcttttctatagggacttcagaaaattaaaggtaactctctgcaggtagcattcttcctttatttttcatcttccaaaattttgttaagatctctcttctgctatcccaatttctttatccttataagttaataccttttaaagtcttctactgccatttcagtgagatttgaggaaggaaagaagaggagtttacatggtctatagacactctctccatttgcttttggacacagtgaattccaagtaacaccacaataataaagcagatatccaatgattgaaaacacaggtgaagctcaagataaaggtcagaattagagatgtaaattggagaactgcttatacagaaatggtttctacaactatcaaaggaaataaacaaaatataaaataaagacaaaatatccaatgatacaatatttagaaatgcctaagctaggaaaaagaaactatcaaagagctcaaagaaggaggaatgataaaaatagaagagtaagtgggttagtactaagtcacaaaggtcaagggagaaaaaggtttcaagagaaaaaaagacaatcaatgatatcaaatgctgctgagaaacacaggaagatgaggatgttgaggacataccatttggtgattaggaagatgatggtgaagtttaagagagttgtttcaatagcatatgagtacaaaagataaagaagtagatagtaaagtagataatgtattggtggttcttttttccccaataatctggtggccagtggaagacaaaaagcctgagataagtgagaggagaatttgaacatacatgaaagttaagaaaagtttttgtgtttttttggtttgttgtttaaggaaaaaaaaaaaaccttagcaagagtacaaaaggaaagatttgaggaaagaatgtaaatgcaaagatgaggaaaatcaaaggataataaaggactggaggagaaaggtaggatatgcactcatgagcacacatgcagaggttcatcttagaaaaggggaaggcattcttactgcaaggcagatatgcagggaaagagaaagaataaaagcagaggtagagagagacaccagaaaaaattctgaaaacctcatgcccaaatgtcctcaagctcagttaaataagaaaccaagttatctgctgagagcaagaatgaaatttatagagagtgaaaaaggtttggaacagctggtctggtaaatgtaatagggggtttgtgggggaggcggtatttattaatttacttaagaaatagcggcagcaagaaaagtctagataaagctattctaagttctgggagactctaaacaaaatatggatttagaaacagcaaaatttctgtttttcacaatagtagctataataatgagagatgctcagtgggtatgaggtaggtaatgtcaagtgatcagaataaaatatccaaaaattaacaaaacctgaatttttcaaaaggacttccttttgtattttactttttaagaagaaataagaaaaagaaaactaataaatcttcaatccagttctttcaacatttattccttgctaatttctgactaataaaagcgttaattccaggctaattaagccttcttaactgaccttcaaagttctcctcaactatgcctaactatatcaactccaatctcctttgtccaaacactactcctccactacaatctaaaatagttgcatttccatgcatagtagttcacatttgcaaatacaaaggctgctgaatcttagaatttatttatctctaccaatgaccaattgttcacaattaggttacttttggtcctgattccttttggaatttatatggaaagatgtaacatttacggagccattcattatcactgttgccttcaccctttccttagctaacagcagccacttgattcatttacctctaaagcattggttctcaaccagaagcaattttgcctcccagagaacacttagcaatgtctagagatgatttttggcatccagtgtgtacaggccagggatgctgcaatcctacaatgcaaaggaaaaccccaccccgtccccaacaaaaaaaaattatctggtccaaatgtcaatagtaccaaggttgggaaatcatgctcaaaagctacctcattcatattctaagacctataaataggtcaacaacgaaataaaacctgcctttggctcaagctcattctctcctctgctcctgatctcctacattcccaggccctttgtctgccttgaccattgagactttgattgcctttttcccagcaaggctatgatatcctgattctcagatccttagctcccttgggccatctgacacctaagatgcagttgcccctgtgaagttccaaaactccccaggcttgtttctcactggggggtctttaatccttgttttctggacttgagtctttgcacggtctggcctctaacataacctgactaatcctaatcatctatttctccctacaccccagggtgacaatatggtttgacagtgcacatcagagcagcctttaaaaggccttctcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaaaaaaaaaaaaaaaaaggccttctcctgtctaactttggagtctcagcattccatctcttcttcctgcagtcacctaaggggctgttacctatctccagaacaacagtttacatgtgttaagacctcattatatggttgctggaggaaaacatgaaccaataacttgcaggcttgagttacaaagaacatacatttaaaccaactgaattctggatctaacagttctttcattcagttaccaaaatatttattgaagtacagtaccaggcatgtgggggtgggtggcttaaaaaaagtatccataaatagctcacagcttagtatataaaatcagatatgtaaataagtaatctgtaattagactaattacagtcagattattcctattttataatatctaaagaaaattgtaaaagaaataaaatccttcctcagaattgacagaactaatggtcttaaaataaaagtacatgggatgaggctgggtgccatggctcatgcctgtagtctcagcactttgggaggccgaggcaggcagatggattccctgaggtcaggagttcaagaccagtctggacaacatggtgaaacctgtctctactaaaaatacaaaaattggccaggtgtggtggtgggcgcctataatcctagatactcaggaggctaaggcaggagaattacttgaacctgtgaggcagaggttgcagtgagctgagatcatgccattgcactccagcctgagtgacagagggagactctgtctcaaaaaaaaaaaaaaaaagcgcatggataaataaatgagcaaatgaacaagcagatggataaatgagaaaccaaatatcaaacaagtaaattttttctgggggtcttaggcaaagtggtacatcatgtaaatgagagcctcattattctactacatctcctttcttttcatcttccttaaatgtcattctcactataaatgctaattggtttagcatatataacaaattaatctgggtgatagaataatgctacaacacaatccatgctgaaaaatctttgcttctcagttttgcagataatgaagcctctaaacagacatagcccaccagtatgtagacagaccaggactgatactaggccaaaagacaccatgtagcctctccagatgtttacagccagtgtgcatctgactggtcagtgcttgtgcctcatcagtggtaagttgttttaatgtcacccttgatcagtacattctctcaattttagagcagcaggcagggctcccaagaagagatttcataactatattatgttcattctccctttaaaagtataaaaattccaattaccaattgacatagcagaaagcatccacctggttagactgacttttcctctgcataataccttgttaatccatcataatgatttattcatattgctgctgcactgagatatcagatgctacaactacgattatcactgttcctcgtaaagtggagtcttacagagctggctttgaacccaagctctatcaggtactgtctacgtgatgttcaacctcttctaggctgaagtacgtgagactttaaccaaatgcaattgaggaaaataatatttaccttagaggtttgttgtgagcattgataaggagacgatatatctatacagactagaacataccaggtgcttaatgaatcctagcttctccttttagccaaatctgatacaaacatattgatcaagttctttcccttccttcctttcaccatgtgatgcctgctccccttcaccttccaccacaactttttcttttctctttgcttaattttctttaagtccctccaccttatcggcaatttactttttcatttatcaaaagttactaagagcacgagcttaccactgcctctcccaaaatatctcctacaaatctctggaatccatagtgaaaagtagaaactatgattccaaatttgcctttaccctaaacacattgttttgcctttgttttaaagtggcttttccctcctcatctctgataattttccagcattaagagcattggcttttgagtcaagcaatcttggattccaaatccaattctgttgcttatgtagtcgaattacttacctggttgacttattaaatttctgtggctctcactgtcccaaaaactagaacatgtatggcaatgggcacaatgcctagcacataataggtgctcaaatatatcatatttaattgttctcagcactggcattgctaaccaagactaccttctcagtcaacaattagtctcaaagatacaatccaaatcatgtcccattagcatgtgccctgttctgtatttattcactcaactaatcatctcctgaatgctgtatatgttctaggcataaaataaagacatttgtacagcactttcaaagataactaaaccaaagtttcagacttaaaggaactcattgtctagtgggaaggcaaacatgtaaacaaataattacacggcagtatactaagtgctaaaaatagatgcatgtacaaggtgccagggaagcaccatagagagagatcaggcaaagcttccttgaagagatgactatgccagagttgagtctgggaggatgagcagggattcactgagcacacaagggaaagacggacattctgggagagacaggggcaggcaacagtggaaagtccatgatgcctgctgaaaacaccaagtacaggaattgagtcgggttggagagtgctgctacaaagaactggtgaaaaaatggggcagttaggagggagccaaaccacaaaaggcctcaagtgatgtgccaaagagtatggactttattcattaagcaatggcaagccactgattttttttgtttttggggggttttttgagacagggtctcactttgtcacccaggctggagtgcagtggcacgatctcagctcactacagcctcaacctcctgggctcaagtgatcctcccacctcagccccccaagtagctgggactacgggcatgcaccaccatgcctagctaatttttttgtattgttagcagagacggggtttcgccatgttggccaggctggtctctaactcctgagctcaaacaatccacccacctcagcctcccaaagtgctaggattacagatgtaagccactgtgcccagcctctattgatatatttctaagtcaaagaataacatgtttataatggcagaggaggaatcaggttggaaggactgttattggaagtggtgatactgagtggacagaagtagtaaggaaaaacgtcaggcatggctctagagtttctagtttaaatgatgcaccatagttcctaacacaaatgatgcaagtaacagagcagaactctgggtacagataattaatgttttgcatttcatacctccattgaggaggagatgttcaataggacaccggggataacatgtctagcgtgcaggagagagaaatgaattacagatacaggtttcgggtagattttggagaataataatttttaaaaccaaagaacatgctttttttttttttttttttgagacagagtctcactctgttgcccaggctagagtgcagtggcatggcgcgatcttggctcactgcaatctctgcctcccgggttcaagcgattctcatgcctcagcctcctgagtagcttggactacaggtgcaggccaccacacccagttaatttttttttttttttttttttttgtattttcagtagagacggagtttcaccgtgttagccaggatggtctcgatctcctgacctcatgatccacccgcctcagcctcccaaagtgatgggattacaggcgtgagccaccatgcctggccaagaacatgctttttaaaagaaatataattcatttagacttctctcccaacttcaagtgaaaagattacaaattaaaaaccttaaattactatctattgcatatatattaaaatctaacattaaaaaatatggaaagatgtcaacacatttaatgaaaacaaaaaactttaacagaggtaagtattgtatatttatttgtctattactttgcttaagcagtctgcttgctaatataaggacattttccttacctataagagtaacgtatttccaaaataatgttttcatggccaaaaaaaagcataacgcttgcttcatcttctgaataaacaagtgtgtttaatttcctgagtaaacattagtcatagttgacactgaacagcgtccaaattcaaggaaggagttaagaaatttctaaaaccccaagagcaatatacctcacccagagaatctagtgaagagcttattataaaggactaaaagtcaatgtcataccaaaattttaaataacatcatgcatccctctacttaataaattatttcaaaatcaggtcacaattgacagacacactatcttgggcagacgggagagactagataagcagggaaaatttccttttctctactgaagcatgtccaccaactgtcatatctggaaaacagccaaaatgagcactttatttgcaaaaagaacaggagatttataatgtgagcaaaatgtgtgctatataaatgcagaatatagagaattattttaagattcatatttctgtatgtttagaaataatgtttcaaagacgtagattaaaaccacaagttcatctatataaaaagctctaaaagccaagggtggcaacgcttaaatccctatagataagctttacccttttcttctgggctgtgaccatctatgcgaggtaaggtttccttataaacttctaagacagataatctggcctcacaggtatctaaatgaattagccacataaattactctgagaaaaccacagccaaatcatgtctctcttaaccttcctttccttctgctccctaaccctctgttttctctttagtcacagagcattttctagtttcctgaccacggggtttaccagccaaagctgacacagctgagttgagaagggaaagcagctgaactataaaggaaggaaatcagagagaaaagaggcagggagtctggaaatgctaactagaggggaaataagaaaaccctggactgtgtctgaatctgtagaaacttgcaactctagattaatgtcctcaactcaggtgttggcggcccttagtcaactaagggtttgcgaaaattttccaaatgggttcctcgctaatctaaaataaatacatattaaaaatagtaataatggcagagtctcaataacatttatagccaataaccagggaaaaggaagggtaggcattcattttgagtgactttactattggaaactcctggacagttacagcattgctattaacacaattgtcactttggataaggtgtccaactgcatcacacagtattttggttctttaaagaagttaggggctgggcatgatggctcacacctgtaatcccagcattttgagaggccgaggcggacggatcatctgaggtcaggaattcaagaccagcccggccaacatggtgaaactccatctctactaaaaataccaaaaattagccaggcgtggtgacaggcgcctgtagtctcagctactcaggaggctgaggcaggagaattgtttgaacccaggaggcagaggttgcagtgagcccagattgtgccactgcactccagcctgggcagcagagtgagactccctctcaaaaaaaacaaaacaaaacaaaacaagacaaaacaaacaacaaaacaaatgaagtgagagaatttaaacagaaaggaagtgggaaaggtaaggtgaagaaagacttctggtttgagtgtattctcttaaaaagttcacaaaatcgctgaggtaataaacatttttccacatgcctcttttctgagattttgtccaccttctcctccagccatgaggtggggctcaaggagactcagcagcccctagtttatgctacaagatcctatctccctgccttcccctcatcctcactgccttgattcctggtcttttcaaggcctggcagttcaacatttccttgattctatgaaagacttctatagtcataaattcccattcccctttaaagaaaaagcaagcaagacctccaaggaaggatatattaaacatggatcttgtacccttttctgcaactcctttcatcagtgagatgatgataatactatagattagattgtggagaaaataggtatctatccatcccaagagtcaagagttttggagggatttttaaaggtaatccaggaacaaataggataggtactctgcatgttcccttgttctgctgatgaatgtcacaaaatacaaagtttacgaagcatttctatggacacccaaggacaccataaaaacagaaagccaagatacaaatactttgaaatactgtgaaaaggtcctacgttattagaggtattgataagaaaacaagatgttaagaaaagagtagaaatcacgatctctttagatccctagatgttttcttgtgtattaagtatgacattttttaaatccaggctggtttagttgtttttttttaattttactttaagttccaggatatgtgtgcagaacgtgcaggtttgttacataggtatacatgtgccatggtggtttgctgcacctattgacccgtcctctaagttctcttccctaaccctcccacccccatcaggccctggtgtgtgttgttcccctccctgtgtccatgtgttctcattgctcaactcccacttataaatgagaacatgcagtttggttttctgttcccgtgttagtttgctgaggatgacggcttccagcttcatccatgtcctgcaaaggacatgatctcattcctttttattttatggctgtatagtattccatggtgcatatgtaccacattttctttatccagtctatcattgatgggcatttgggttggttccatgacttcgagattgtaaatagtgctgcaataaacatacgtgtgcatgtacctttatagaatgatttatattcctttgagtatatacccagtaatggtattgctgggtcaaatggtatttctggttctagatccttgaggaatcaccacactgtcttcaacaatgattgaactaatttatatgcccaccaacagtgtaaaagcttcctatttctccacagtctggccagcatctattgtctcttgactttttaataatcaccattctgactggcatgagatggtatttcattgtggttttgatttgcatttctctaatgatcagtgatgttgagctttttttttttttttttttttgagacggagtctcgctctgtcgcccaggctggagtgcagtggcatgatctcggctcactgccggctccgcctcccgggctcacgccattctcctgcctcagcctccggagtagctgggactacaggcgcccaccaccacacccggagaattttttgtatttttagtggagacggggtttcaccgtgttagccagaatggtctcgatctcctgacctcgtgatgcacccacctcggcctcccaaagtgctgggattacaggcgtgagccactgtgcccggccgatgttgagcttttttacccgtgtgttggccacgtaaatgtcttcttttgagaagcgtctgttcatatcctttgcccactttctgatggggttttttcttgtaaatttgtttaagttccttgtaaattctggctattagacctttgtcagatgggtagattgcaaaaattttctcccattctgtaggctgcctgttcactccgatgatagtttctttcattgtgcagaagctctttagtttaattagatcccatttgtcaagagttctcttcttaaggtagtaaaactaaaattcagatcatctttccattgagtttgttttcccaaacctagggaaggagagcaggaactggtaatagtgcctgctgtttattttttcttaaatgtggcatgcaaagctgaatgatcttttaaagtacagaatataactgcaatgaattatttctgcaatacttccaactatttttcccatttctttgcaattaatgatagcatttttttggctatagcaaatgtttactaaagagcttcctggacgtttctttgcttagatttatttctaggaattatagtttcctgatagtaacttaaagcttgggaaattcccagtatgaattacttactgtcctggttcatttgaagcaataatcatttttataagacctgtgcagatgtgccatattttataatatacttgtgtcaatttccagacatatttttatgacattttaaaaatcatagtgggaatatcatataacaagaaaaacctacttgctggaatccttatctctatcgaattctgcaaactcaacttcttcagtgaatgacagttaatatctcagttcttttataactctttttcggcattatcatcatcttactaaaattcttgagaatgcactttgctgataattatgataaagaaagaccttcagctaaacagcaaaaaaatatataaagattttctgtctctcattctggaggcctactacatgtccacaacactatacatgaaaaaaagcccattaaagaatgcaaagtgctgaccagcctatcaaattatcatcatctctcctccaaagtgcaaggagaaatagtatccaggagaattgccacacagtgctcatgctttggtcataatctgatgttacctaaaatcattaattgcccaattttcttccaatacaaggtacagccaatgctgactttgaaagagatattatcattgtcatcacctagataaaaagaagagcctcctccactttctcttccactccctattcctcttttccttccttctcatttcccttctcttcctgaaaaattcagttcctacactattaagtaacacagagaaaggtaggtgtccacatcagaggaaagatggaaggcacagtggaaaggtaggaggtgtgtccatattggggcaggcctagtgtggcgtaccatagcctaagtgagagggcatcccttctggcatgatatgagagggttagaacccacacagggtgaagagggtgcccatgtggtgatggcagaggggaacaccccagcatgggatgtcagtatccaaacagaatgagagggcatccacatgcaagggtgacctagtgcagggggattagagtccaagaaggatgaaaagattattcccctgtagatgcagaccaggagagagtcagatatgaaaagggtgaagaggtgtctctgcagaaggacagcctagtgtggggtgacagagcctaagagggaaaaggaggacattaacagaagggaggggacgatagtggagaggagattgatagcatataagacgacttatcaaataagtatatatacaaagataacagaagccagactggaggatgaaggaagttacaataaactcatatttttaataactatagagatgtaaatatgtgtacacagtgatgtgaatatattcactccctggctgagaggatctgggagatatgacactccaaaagccatgagcataacaatacccaaatcttagcttctaatggcccactttccaataaaaggaaccaggccacttggagaaaaggttgattccagggctaaggcaggaaaagatgagtcctggaacattttatgatgccaaaagcaaggaaatgctcaaggaatggctcaaaaaaaaagtcagcctaaaagggatcctactaagtctgagataatttaagcatcaaaattaataatgatagcagtgcattataacctaggcaataaaacagcaaaccatgagtccacactgatataaataaatgaataaaagaaagtttgatgaggaatgggatatctgcataaatgtacctccacacaaaatagttattaaagggggaaaaaggtaattatatatatagaagtttgacaaccaccatcataagcaagtgattaaaatgaacattatcagcaacgggacagatcaaatcccatgccacctgacaggatacaatgaaaagaacagagcatccctctgtggcattcccaccaaaggtgcacaacctgggccaggcacggtggctcacgccagtaatcccagcactctggatggccgaggcaggcagataacttgaggtcaggagttagagaccagcctggtcaacatggtgaaaccccgtctctactaaaaatacaaaaattaggcgcatatttgtagtcccagctactcaggaggctgaggcacaagaatcgcttgaacccgggaggcagagcttgcagtgagccaaaattgcgccactgcactccagcctgggcgacaaagtgagactgcatctccgaaaacaaccaaacatcaacaacaaaaaaagtgcacaacctgaatgtaataataagaaaacagcaggtaaacccaaagtgagggacatcttataaaataactggcttattgtctttgtgtcaagatcacaaaagtcaaagaaagactgagaaattattcacactcaagaagactaaggaggtatgacaactaaatgcagtacatgattttgaacttaatcccaataaagacattattgggacagttggcaaaacttgaatgggatctgaggaataaatggctgtaatgtgacaaagttaattttcttattttagtgactgtattgtggttaggtcgaagaatgtccttgtctgtaggaaatacaaactaaagtattctggggtgattaggttgacaacttacttgcaaatggttcggggaaaaaaaaggttatttaaactatatttccagattttccataatatgtgattatttcaaaataaattttaattttaaaaataaaaatatttgacagtatgtagttctacctccaaacattaaagaattacctgaacctgactcatggtcggatttagatctgatgtatgatgggagatgagagccaaatgctgacaccagactgctcaaacgaaaaagctaaatttgtgagtttttatgccctagtaaaattagatactactgtatagttagctattatctcatgtaaatgatttttgtaagggcctagagagaagagtctattttccagcctccaaagcaccatcaccatactaaatgcatagtgtacacctcaagatatttccataccataaaaatatgtctcaaaatattttaatgcttttaaaaaggagaaaatagtaatgataggcttactaggaacccattaatctcatggattacagcacagcacatacaacttccgtggaacacaatttttttctgttcaagttatctttgtgaggaatgtacaagatagaaaacaaatactaaatctttggtgaccagtaccactcctaaaagcaaaaggaaaaaagcaatcctctgcctctgggatcagaggaagattggccaagcagtgtcactccctatggcctgtcttggtgcctacagttacaccattaaagatttaggttaagacagtgtaaacaaatgacttattataatgcaaatattccagagtttcccattcaataaaagatactcatgaaatatataattatgatttataattatgaataatttattgaatatctaaattatttattgcatagatattaatgcttagtaataataagcattttatttcctcctgtgtaataggcactgtgatagatattttatataaattatctttaaccattccaactctacaagatagatgttatcacctccactttataaataaggaaactgaagcccaaagaagttaaatcacctgcatagcgccaaatgtcctttcagttgcagagtctgcattcaaactcaagactcggaatttttccattacggttttttcttttcttagagattgggtcttgctctgttacccaggctggagtgcagtggtgtaatcatagttcacagcagcctcaaactcctgggctcaagcaatcctcccgcctcagcctcccaagtcacagggattacaggtacaagtcactccattacattctgcttcttctttcactatgtaatttactattctgaaaaatagaacctggcgcagtggctcacacctgtaatcccagcactttgggaggctgaggcgggcggatcacaagatcaggagatccagaacatcttggccaacatggtgaaacgccgtctctactaaaaatacaaaaattagctgggcatggtggtgcatgcctgtagtcccagctactctggaggctgaggcaggagaatcgcttgaacccaggaggcggaggttgcagtgagccgagatcacaccacggcactccagcctgggcgacaagggcgaaactccgtctcaaaaaaaaaaaaaaaagaaaaagaaaaaagaaaaatggagatctatggtatgagggaataaaatgccatataggaaagcttcttattggtacaggataaaactaaattatgagacttctgagtttggggtagaagaagccaaagaatgccttagaaccatgaaaggaagaaaggctaagcaaagggacataagggcacaggaagaggggatgagaaaggtctaaggacaaactgcctggttccccagttttcctacacagcctaacactagagttgacaaaagtccctgaattaataatgagctcagttaaaaacgacaggcttagatttattggcctgaaagagatggatcataaatgagggctgtgggctgggtgtggtggctgacgcctgtaatcccagcactttgggaggccgagacggatggatcacgaggtcaggaaatcgagaccatttggctaacacagtgaaatcccgtctctactaaaaatacaaaaaaaaatagcccggtgtggtggcgggcgcctgtagtcccggctactcgggaggctgaggcaggagaatggcgtgaaccctggaggcggcacttgcagtgagccaagatcgtgccactgcactccagcctgggcaaaagaccgagcctctgtctcaatcaatcaatcaatcaatcaatcaatcaatcaatgctgtggtgaacactgtactttccttctttgtgtgaaaggaatgaggacaaataaatcccacgtacatggtttagatgtttgttccctccaaatctcataccgaaatgtggttcccagtgttggaggtggggtctggtgggaggtgcttggatcatgggagtggacccctcatgaacggcttagcagcatccccttggtgatgactgagttctccaaatttacatgaaatctggttgtttaaaagtgtgtggcacctccctgctctctctcttgcccctggtctcaccattttatacactggctcacctttgccttctgccgtgattggaagcttcctgaggcctcacctgaagcagatgccagcaccatgcttccagtacagcctgcagaaccctgagccaattaaacctcttttctttataaattatccagcctcaggtatttctttatagcaacacaagaactgacacactcgcccatctggaaacatgggatggacaagttattaaaatacctttgaagacaatagaagttagacaatatcaagcacctagaattttgggggtaaaaaattccacactgggtttttgtgggggttgttctggttcaggtttttttctttttgcccaggctggagtacagtggcatgatcatagctcactgtagacttgaactcctgggctcaagcaatgcttctacctcatccccctgagtagctaggactataggtatgcgctaccacacccagctatttttatttttttattttctgtagaaacaggatcttattatgttgcccagcctggtcttgaactccttggctcaagcaatcctcccgcctcagcctcccagagtgctgggattacgggtgtgagtcaacacacctggactaacactgtatatagtgaaaataactgacaagggcatatttttaaaatgtctttaggtgatttactttaccactcagttcagtttactgttcatgtgctatcaagaaacaaatttaaagcaaaatactgccaataatatgaaactgataagcacacaaaaataattgagaactatgtaggaactgaaatatattactatataattttgtagaaaatgtactttccatttacatgttggaaatatattggtatattcatattttaacataagatatgcattgatccctatggcactaggaagcaatacagcacaattgaaagatatctgggatcagaaacacctgaatttgcttcttgaatctgcatgagtactgattataaaactactgactttgtaactctgggcaagttattcaatttttctaaccttttcacccataaataaaaatggggaagacattgcaagacttgtaaagattgaagaatataattttatgtaaaaaaagtggcctgtgtgatgtttacaacattgcttataataataataaagtcaaaaatcatccaagtatctatcattaagaaaatattaagtaacaacagtatatacaccagattagtggttctcaaattttagtgcacataagaatgttctagggggttgtaaaatgcatatttccaggccttacacttagaaattcttagaatactcagaaatcctggggtgggatcaggaaataacacgtttaacaaacaaccataggtgcttctgatggaggacatctatgaaaagtatgcagtagatggaatacgatgatgccattaaaaataactatgaagactttgaaatagcattgaaaaggtgtatgatatacccttaagtgaaaaattcaggatccaaacttgtacgctttatctgataactacattaaacatgcttaagaaaaaagttgtttttagcaataagattaaaggtaatttttgatcttttactcaaagttttaaatagtcatgctattattataaatgaatcactaacacattaaaattgaaaaaaaaaaacacattggatcctcatggccttcaggattaggctcaaactccttagggcaacacacaaggtccttctatctccagacttagctcttgtccatgctccatatcaaactacttataataccccaagctatattctatattttcacacactattattgaatatactgttccttctgcctgaaatgccctttctccaacttgtctggaaaattcctattcatcccacaagattcaagcactacctcctctctgcagtttcccctgaatactcctccaagtcaaattctgggtgcctccttcttgctcctagtattcctacagcattatttggtatttccattgctccatatatcaccctgtattttacctttttgctgatagatctatcccattattctgcaagtacatggggtaggtagagatgatctcatttagttttagaatccacaaagtactcagcaaatacttgttaaaataagtaaagacctattttttgttatcactgttcttagttatcagttttctaaaaaatcctgagtgccctgctggttagttggataacacttggctcaatgattaatgagctttgtctaatatatacatatatatatacacacacacgtagcataaaacaaacccatgaaaaatttttaagaaatagtttaaccattgtttgtaattcttcacgttctctgcttatgtcttcaaagtttctatcaaccttcaggatgacagaccactctggtcaatagccaaagcaggctaacaggaataactctgctctgggctcctccattgctggagtttacccagccaaagaacatccctgcagaattcttgctgcttcccccaaacacactcccactcactgccatctccgcactagcagtaaaatatctatataaaacagagataattctgtaagtaaatagagcagttttttagtatattcaaaacactagatactatatttagtatatttgtgtaatacataaaacatttcaaatgcagattactaactagaggtaccaaacaagaacctaaagtgactaatagtaattcaggccaaaaaaaaaaaaaagaaagaaaaatcaatgtggaagaatactaattgagatccaggtatcagaacttcaaatgctttccctgtaccgtaaaacataagttttaggaataacctggatgctgaagccaacttgcaacacaatttttttaaaaagaaaaacaaaatacattttttaacatttgaatctcaagccacattaggcattaaagctgtgatacaactttgttccatatctctgtcacctgtgatataataaatgtgtacagaaatacttttagtgcacacttcatagatactgtacttttttaaaaattgaagatttataggaaccatgtgtctaacaagtccatttttccaattaggccaatgtgctcagttcatgtctctgtgtcacatgttggtaattctcacaatatttcaaactgtttcattatttttatatctgttatgatcatctgtgaactgaataatgctgtgtgtgttctcaccactccaccaactggccattccatctctctccctctccttgggcctccctattccctcggatacaacaatattaaaattaggccaatgaataacccttcactgacctataagtgttcaagtgaaaggaagagtcacacgtttctcactttaaacgaaaagctagaaatgaataaacttagtgaggaaagcatgttaaaagtcgagacagactgaaagctaggcctcttatgcctaacagttagccaagctgcaaatgcaaaggaaaagttcatgaaggaaatgaaaagtgctactccagtgaacacatgaatgataagaaagccgaagagccttattgctgatatggagaaagtttgaggggtctggatagaagatcataacagcaacacaacattcccttaaggcaaagcctaatccagagcaaggccctaactctcttcaattccatcaagagctgatggagctggggaagctgcagaagaaaaatctgaaggtagcagaggttcagggggcttaaggaaaaaagccatctccatgacataaaatggcaaggtgaagtagttaaatgctgatgcagaagctgcagcaagttatccagaagatctagctaagataattgataaaggtgactacactaaacaacaaaatttcagtgtagatgaaacagccttctattggaagaagatgccatctaggactttcatagctaaagagaagtcactgcctggcttcaaagcttcaaaggacaggctctcttgttaggggttaatgtagctggtgactttaacttgaaaccaatgcttatttaccattccaaaaatcctagggcccttaaaaatgatgccaaatctactgtgcctgtgctctgcaagtggcacaacaaagcctggatgacagcacatctgtttgtagcatggtttactgaatattttaagcccaatgttgagacctaccactcacagaaaaaaagattcccttcaaaatattacagctcagtggcagtgcactagtcacacaagagctctgatggagatgtacaagagactagtgttgtttccatgcctgctaacacaacatccattctgtagcccagagattgaggagtaattttggctttcaagtcttcttatttaagaaatacattttgtaaggttatagctgccatacctagtggtagctatagaaccactaagaacatttgcgggccaggtgcagtggcccatgcctgtaatcccaacactttgggaggccaaggtgggaggatcacttgagcccagaagttcaagaccagtctgggcaacatagggaaaccctgtctctacaaaaaatttaaaaattatccaggcttggtagcacatgcctgtggtcccagctacacaggaggctgaaagcaaagaatcactgagtctgggaggtcaaggctgcagtgagcacagtgatcatgccactgcactccaggcctgggtgacagagtgagaccctatcacaaataaatagataaaacatttgtggttcatgggaggaggccaacattaacaggagttttggaagaagttgattctaactcttatgactgattttgagggattcatgatttcaacagaggaaggaactgcagatgtggtggaaatagcaagtgaaatagaagtgaagcctgaaaattggactaactgacaacaatctcatgataaaatttgaacagataaggagttgcttcttatggataagcaaagaaagtggtttcacgagtggaatcgactcctggtgaagacactgtgaacattgctgaaacatcaacaaaggatttataacataacataaataaagcagcagcaaggcttgagaggagtgactccagtgactccaattttgaaagttctaccatgggtaaaatgctatcaaacagcatcccatgctacggaaacatcttttgtgaaaggaacagtcaactaatgtgaaacttcattactgtctcatttaagaaattgccacagccatcccaaccttcagcaaccaccattctaatcagtcaccagccaacaacattgagacaagaccttctaccagcaaaaggattacaacttgctgaaggctcaaatgatcattagcatttttagcaatgaagtattttttaattacgtacattgttttgttagatataaggatgttgcacacttaacagtacaatatagtgtaaacataacttttatatgcactggataaccaaaaattttgtatgactcactttattgcagtggtctgaaaacaaatccacaatatgtctgagctatgcctgtacatctaagtaataacgtctgatataggcaaataatatatgtttatatctaaaatgggtttatataatccaataaaaaattctagagactaaatgagtagcaaaaagaaaatacttttctatcaccagccatatactctctcatttctcatgtctccagtcaaatcccttccccttcagcctttaagaaggaagaattagccaggcatggtggttcacacctataatcccagaactttgggaggccaagtcaggaggatggcttgatcccaggagttcgagaccaacccaggagttcaagaacagcaaggcaggaggatcacttgagccctcaacaacagaccccaacagacagggtttccctatgttgcccaagttggtcttgaactcctggattcaagtgatcctcctaccttggcctcccaaagagctgggattacgggcatgagccactgtgcctggcccacaaatgttcttaatggtgtctagcatggtcaatcctttccagaaggttttcaatttactttgcacagattcatcagaagaatcactatgtatggcaggagtttgaggaacagtgaggctctgtccttataaaaaaaaatcaaaaaattggttgggcatggtggcacatgctggtagtcccagctacttggggtctaagacatgagaatcacttgaccctggggggcaatgaggctgcagtaagctgtgattgcaccacagcaccccggcctgggtgacagagtgagaacttgtctccaaaaaaatggaagaattaccacctgtatccaacattctcttacgagcctggcaaaatccactccatttgttctgccagaagaggtcgatggctttactattttggcctaatgttttgttgcctctttaaatgaaaatacgaaaagagctgcttctttctaaaagctttaccaatcaattacaacttcactatgaattaactgtcaggtcccacaaacactttttggtggtaaagaaaggaaagaaaaggcactgggtccatgacgttagaggataaattaacattgaggtataagcattccctttcctctgcagcctcaccagcatctattgtctttcgacttttaaataacagccattctgactagtgtgagatgctatctctcactgtggttttgatttgcatttctctgataactagtgatgctgagcattttttatgtttgttggccacttgtatgtcttcttttgagaaatgtctgttcatgtactttactcattttttaatagagttacttgttttttgcttgttgacttaagttccctatagcttctggatattaggcctttgtcagatacacagattgcaaatatcttctcccattctgtaggttgtctgtcagtgtggaaggtagtacagagatttctcaaagaacctaaaattgctaccattcgacccagcaatcccattgctgtgtatatacccaaaagaaaataaatcattctaccaaaaagacacatgcattcatgttcattgctgtgctatgcacaatagcaaagacatggaatcaatctagatgcccatcaatggtagactggacaagaaaatgtggtacatatacaccatggaatactaggtagccataaaaaagaatgaatccatgtcctctgcagcaacatggatggagctggaggccataatcctaagaaaattaacacaggaacagaagaccaaataccacatgttctcacttataagtgggagctaaatataaagcatatgtggacataaataagggaacgaaagacacagtggactactagagggtggaaggggggtagattaaaaaacagcctattaggtactatgctcactacctaggtgacaggatccatgctccaaacctcagtgtcatgcaatatttccatgtaactaatctacatacatacttcctgtatctaaaatctgttgaaaattttttttaaatattcagataggctggaatctagagatgatgccagctggcacaaaaactggagccagggtgaacttgtagtaattagaaaaaaacgctttttttctgagatgtgattgaggagggttaaagggaatgtggtgtgggaaatagaaacaggaaaggaggttggctgtttatgctcacatccatcaatcaagatttgatccaatttgatcaaagaatggtaacaagtctaagcagtttgtttcagttcagttaactagaagtgattaaccacttcaaataaagctactctcataacacaatagaatccaaataactctactgcacagcttaatcaaagttccatttcacaactagatccatgaagacatgtcatttaataagaaacatgattcataagaatcagattcagagatgaacactctggacagtgcagtagaagaaacagagtgtcttagtctattttgtgttcctataagagagtacctgagactgggtagtttacaaacaatgtatgtttttgtgattcacatttctggatgctgggaagtaaaagagcatggtactagcatttgctcagcatttggtgaggaccttcttattgcatcatcccatggcagaaggcagaagggcaagcaagcatgggcaacagaaagaggaaattgggctgaactcattattttgtgaggagcctcccatgacacctaacccactcccacaataatggcattaatccattcatacatgcagagccctcatggcctaatcacctctaaaagatctcacctgtttgttttgtttttattttgagtagggtctcactctgtcacctaggctggagttcaggggcatgatcattgctcactgcagcctcaaactcctgggttcaagcaattctccccacccagcctctcaagtagttggggctacagacgtgcaatgccacacctggccattttgttttgttttgttttttatagagacagggtctcactatgttgcctaggctattcttgaacccctggcctcaagtgatactcccgtctcagcctcccaaagcctgcgattacaggtgtgagccaccacgtccagacagatcccatctcttcatactgtcacaatgacaaataaatttcaacatgagttttggagacaacactcaaatcatagcactgtggaaaacaaaatttatcctttggtcatattttttgatccatcttcaaatatcaattaaaagcctcatccagatttaacacaaatgtaaaatgtatttgatatcctactgacaccaaagaagaaaagtagactcttaagaaaagtttctagatctgtattacacaagaaaattcaatgagttttcaactggcattgtgcctctgcctgcccgtacggcttacataaccatgtcctcacatgcatgagaaagaactggaagatagaagcgtcttctttgtaaattcctttttcaaatataaaatattctcccatatcaacatatgatgagtaataaaaactcactgtattttaattaactaacatcattctgcaatatgtccaaaacggaaactaaagacactctaaaatgcattaagtgttaaatatcttcaggttccataggttgaaattagtcttttctaacctttgtctggcattatagtcagcttccatttctagttaaatactcaggaataatgttctatcataggcttctgatagaattttccaaaattacctcaaaattatttcagtatataactgaactaatcaaattgtttactgtcacctgaaaggttaagttgctaaagtcagcagaggcactaataaatattatatgcttctgccttaatgtcagtgaagacttgcatcagcctttgtcatctgtaagaaatcgagtcacacaagaaactgtgcaatggatggacaggttgagtagtagtcactggctggctgccctagttcactgctacacatcaccctcagtgttttgaaaagggagctgaaaaccctgctcagtggagaaagaggtcaataccaaaattcaccctcctttctccttactccccatcatgcagctggcactgttcactctggcagatacagctccctgaacataatggtgcaatcaccacttcaaacatcattactatctaaaatagataacccacttgcaacttgactatttttatagatataacattttcatggagcttaactgctctatttgtgatttattccatttaaccaatgcagtttccctgaaagtgagtttcttatatcagggtcccaataaccacaattgcccaaatagttgtgaaaattacagtacttcctagttgtctgttatctccctgtattcatcaccaaaatgacatgagctgaatcctaaatctgaaaaattataagctctctggtttttatgtttttggtgaccagaagattgttttgctccacttcttattgatctactttttcacatggggatcttaagaactgtattatttatttctgacaagaatttactaaatacaccttatataaaactcaactcttcgaggcattaagaaaatcaaataaattgaggcattaataaagttttatcactgtattaaaatacaaataattctctatcctatactcagcaaaaaattaattaaatatacattttaaatggaaattagttttgtttagaataaaaggtagttgtgccaaaggaagagaggtttttttttaagattttgcagctgtctcataaaagatatgttaaataaactgaaatttcacataaaatgtagaggaagaaaaggagggaggcaactcaattttagtgctctgatgagctcagatttctttaaggatgaaagggggtagtaagaggtataactgcaagcaaacacaaaaaaagaaatatatacttgtccaggaaaaatgctaatgtcctttttagctaagtttgaaaaagagaaaagaggtgtaacagttcactaatttcaccttcagttctggcagagtaaaaggaaaactgtgggtagttttaaaccacaagataattttctatgatatctaacaatgccaagaatctaattcttcccaacttttattttgcttctattttccctattgagaaccattttcaaatcagaagggataaacaaataacttcaggagattactgaaggtccaaacgagaccataagggacagtaagctgctttaaataagtatgcatatccagacccagaagaattagatgcaagagggtagaaggaatttttgccaatactaggaattaccaatggctcactgccagaaacaagccataataaagtagactgattttgatggaatttaaaggatagatcaaaagaatgccatacacttaaatacagtgtgaatttagaaaggcagtagataaaatacctcacaatattctcacaggaacaatggagagaaatagctgattgtcattgcgtggcttcaatcctggtagaaataccatgagtaaagactgttacttttaaatttatactaagttgaagagaggtgctttggggatatagcacagtgtgttgaatttaggttatagaaaacatgcttattacatctctggatgatacaggggagagaagttaatacgctgaaagacagactcaagagtcagaaagaagaaaaaaaagagtcaaaaagatatagagaaattacaaatacaacataaaacaaatcagataaaaaggaacaggaataatttaagctcaatcaacacttttaaaagtaccagaaaggggacctggcttcacaggtcattgaaaaaaaaaaataccaggaaattttaattgactgtatgttcaacatgagccaacaccattacatggcccagaaaatcttgacctgtaggtaggtcttagatcaataataaagagataataatttcattgtatcatgttttaatagctgctattttattttaattacataatacatattcattacagaacactgaaaataaagcccaaccacaattccaccactcaaagatgaatactatcttcattttggcatcttatcattccagacttcttaagcacattataagtgttcaaacaaacttattttttcttgcaaaaataagatcatactataaatgcttcttgtaacctgctgtccttggttttcttattcagccataatgttctactctggtcaagggacatctactgcattttgtgaatttctagtcaccatactttaagagggtcattgcaaaatttgagaatatgtaaagaaggaaagagagagtagagaaaagtatgaaaactaagttcttaacatctatgctgtcttgccatataaaaggttaacagagatgatagctcttccatgaaaaatacttataagaaaacaaaaatacatgcatctaaagaactatcctgcagatgaattagactgctttatattgacccatacagccaatctactaccaattgctgaaagtcacagggaagtggattttagctcaatgaaaagaaaaattttaaaataattacagctgtcaaaaatagaatgaatctagtcattggaaggtttaacagggctggaataactaacaggtaagaaatgttacagagaaaatttccgcactaggtgagaagttggaagaaagttccctccttatttgacgattctatgattgctatgggaaatttactcccagtccaataggaagcaaatctttagtcattaaggccttaaagaatacagtcaagtgctttagaggtgcatgaaaaatattaacactaacgatgaacacctatatgctaaatgttttgcattcattactttatacttcatttaatccttataatgatcttatatgataggtactattattactatttccactctgatagaatagtgaggcttagagaggtttttaaatttattcaatggcattcttacatttgctgaaaattgcagtgccacccaaaagcatacctgattccccattacatagttactgttgaaaggataatttcttattaccagtagataacaagtaatcagaagcatcttcagaaaagttcttgtctagtgaaccctcaaagggcagttgtgagatttttttaattagaaaaaaataccaaaatttaaggaatttcaaattattcttcatagcaaaaaatgttcagattggcctgtctaaattggccacatacctttaaacttttgtgaataaaacagattcaatgaatgagacttaaaatgttgtaaaacaaatctgaatcacagattttcaaatctttgccattattaattaagtgaccatgggcaagtccttaatcttatctttttattccttcatctgtgaaatgacaatggacctcctaaggctgacacaagaattgaatgagatgacacgtgtaagcacttagcatagggtctgacaccattattacacaacccaggtaataaagcaagcggggaaaaagtgccaaacatattctacagttccttctaaaacattaagaaatttcaaagtgtcattatgtttgacgggggacacattttccattatcctgccaataaatttctgatgacaatcatttttgaaataaagtgacaactaaataaaatgtgccttcttaggaatgtcattttatgcaaatgattgcccaaagaatacaatttcaactctcattttcttcagacactattcagtataagatggataaaagcaagtttaaaggttattggttttgtttgtgatttttacaacttggttcgaagtactctaataaacacatgttgtttacttttgttttctatgtgcaatctttgttgtagagctactactactactactacaccagcaaaagagaaaacctctcactcaagatatacactgtgggtcactattttgatactttagtgtccactaacattaaatacttggtgttttatccctaaaacttgacatctattctttaaaaaaaaaaaaaaaaatcacagctgggaaaggagtatttaaaggatgtttgcttttgagttttgtcacaaggagtgtttttaaaatacgatttatcacaataaaattaagtgaaattctcactgttctcaaataattcctcatgttttcccgaagaaattgtttattttgagaaaattctttcagcataccagtttttagacataatcatttttataactgatggatccacagcaaacgttgttattttacgtgtaacttaaaactgtaaagagataaattgctttcacataaactacatgtgactacaggcaattattagagctgcaatctgaaatatgcacacattgtctacctgtgtttgaaagagaagattatttaacaagggagtacacacaagtcatctctatgacctattgaaaaaatgtcccataaatattcattcttctgacatgaactatcattccaataaaatgtcactgtcaacgagtatatagaataacatatggggctttttaaaatcccatcgactatttttcaactcaatttatttcactgtaatagaaactttccattttcccttttagctagccctataattaattgcactgtctgaccaccacaacctatgagaacttgtgtaaagaacgcaatgtcatcacccaaaagtttctattaagcacttgtcaagggtagcatggaacagtttttaaaaaaccagggaaatcacttgggctttctaaaatttttacaactatagttgggttatccaagagatgttttaaggcgaagatatgaatgacaattgatgactccaaaaatacccaggataaattggatagccacgattttagaaactaaagagcttcccttgaattgtatctagtgaatactctccaggcttcctccctcccagttgatttcatttgtccatcaatacaacttttaatagtttctcaagtatggaaatcaaccccgctatttccaaggtactgctgaatgaagaccttgacattttttttaaatgtcatcttagaaagattctccaagcaataccagtctcacctacgacatcttcacgttaaaaggcctctaccgtactccatatacagtatcccaataccaacctggcatccttcatcctgagctataacaaccaagtttcactcagctatgtccaggtaactgaaagtattgctggggctgcctaacctgccccatcaagttttatacacaccctgtgctgaagacatctcaccagaaagaaggttcactcacttcattttgtgggatcataacccacggcacagcaaacgccttctgcaagagaaggtaggagccaccgaaggctgtggcttttgcagggtaattgcatgcacgcaagagattctctgccaatttcatttaactagacaaaaaaggctgcgttcaaagctgcaaatatgtaataaatgttgatggaaagcgggcggaacgtcgattttcttcaagcaacactagtacatgtacaagttctgcaccagggctcagaggaaaagtagcttactgacgcattgatggaaggctattttaaaattactcaaagaatctaaggcatcaatctgactgggaggctcatacctcctctccatacacgcagtctgttttcctacctaatttaagaatgaatcgctggcagccaccaggtgcaataaccgtgaggaggaggacgtatatccatcacaatgcataatgaggtgtgccaaccccggagctggtgcccgtccttaccttagcagattagacaggggcaggggtccggatccaccgcccaggatccctcctttcctgccagacaggagtttctccaccagagccacatttccagtgcgagcagcttccagcagctcctggtccttccccatagtctctcaccgactcccccacagagtccttgcccccctcgggtcctcctccccacccacccccactccccaaaatccagggccctcttcgccccaccctaaaataatgcaagagcttcagcacggagagctccctgcagccccaggcagggagcacgactctctcctcctcttcggggcgcagcttttacaatggggatcagaccatgtcttgaaagaggggctggccgagctgggagccgcgacgcgcccccacagccactcccctgaattcccaaggcctcgttcccgcgggtgcggcgtgagggggtggggactcgggggtgcttttgaggagcgggaggagggtggtgaggactgaggtcggaggaggaggaggaggcggcagagagagtcctagctggagcgggagcgcag

SEQ ID NO: 1467 - DNA, 150923 bp, Homo sapiens
tgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccac

SEQ ID NO: 1468 - DNA, 410894 bp, Homo sapiens
tgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattaccc

SEQ ID NO: 1469 - DNA, 411117 bp, Homo sapiens
tgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattacccagcccaggctacacctcgcattttcaataatagccatcagataaggcagattttttttgtctgcaagctgtaagcctgctgctgctgcttcctcctacacacccatccaagcgtcaatcttgaatgatgagagcagtcaaaacaaatgcagaaaatagcaagattcaaaagcaaaccaaagtgcttaaatctgaattgaatcttcatactggttatacgttac

SEQ ID NO: 1470 - DNA, 410826 bp, Homo sapiens
tgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagt

SEQ ID NO: 1471 - DNA, 410826 bp, Homo sapiens; identical to SEQ ID NO: 1470

SEQ ID NO: 1472 - DNA, 410826 bp, Homo sapiens; identical to SEQ ID NO: 1470

SEQ ID NO: 1473 - DNA, 150923 bp, Homo sapiens; identical to SEQ ID NO: 1467

SEQ ID NO: 1474 - DNA, 150923 bp, Homo sapiens; identical to SEQ ID NO: 1467
